United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 6

SEQ ID NO: 246 - DNA, 329157 bp, Homo sapiens
agtcatattgtcaattgctatgtttggcgactgtttttccctctctgtttctgtccaaatctatttttcatctttttctgttcatcaatatctacttgtcctttgttcttattctaaatttaattatctatttaacacccaaatcactgtttatagtccatcatcagaaatgtattggaggaggatggattccaaatggtctgtcccctgattgttaagaatttaggtacatggttacatttctgattagttactctgtacctctttcttattttatctagtacagaagctcttttttttttcttttttttttttttgagacggagtttctctgttgccaggctggagtgcagtggtgtggtctcagctcactgcaacctccacctcccgggttcaagtgattctctgcctcagcttcctgagtagctgggattacgggtgcccaccaccacacccagctattttttttttttcttagacatggggtttcaccctgttggccaggctggtcttgaactcctgacctcaagtgatccacccatctcggcttctcaaagtgctgggattacatgggtaagccaccgtgcctggcccacagacattcttaaagtgtgattcaagaacatcccggggtccctgagacattttcaaggattgcaagaggttaaaactattttcattataatactaaaaccttaacttcctgtttcattcttattccttcacgagtgtacagtgttttccagaggctctataatgtgtggcaaggctggacacggtggcttacacctgtaatcccagcactttgagaggtcaaggtgggtggatcgcttgaatccaggagttcaagaccagcctgggcaatatggcaaaaccccatctctacaaaagatataaaaattagctgggtgtggtggtggtgcatgcctgtagtcccagctacttaggaggttgaggtgagaggatcagttgagctcaaggaggtcaaggttgcagaaagccatgattgagccactgcattccagcctgggccacagagtgagaccctgtcttaaaaaaaaaaaaaagtgttgtgacatcattcctctgagagctaatggacaatgtgcttgaatatttttgtgtttgaaaattttttagttttcatttttttaaatggcaaatatcaataaatataacctacacagagagaagctttatgaggttatgaattacatttaggagtgtaaagtggtcctgggacgaaattgagaaacactgctctaggtttcataaattcatcctgtttccattccagtttttaaatggacaatggctattccatttcttgggatttctcacttacaaaattagctgttagactggatagcatctataagctatccatttatctgggcttctgaaaatgaggcatttccttttctttctttctttctctctctttctttctcttctttcttcctttctctttcgctttccttctttccttttttctttctctttcttttctttctttctttctttctttctttcttccttccttcttccttccttcttttctttctctctctctctccttcctttctttctctttctttctctttctttctttctttctttctttctttctttctttctttcttttctttctttctttctttctttcttctttctttctttctctttttcttctgctagtacccatataacaaaaataacagctaaggtggggttataaagaaaaatggatccttttgcattcttgtgtcattctctctgatctatacagtagttctgaaaccgataatttaggctgagtagctctatcaggactttcaaacctaaaagatacgtaagaaatgagtgtgtcgctcttaaaggtcaaaatgaagaaacaacaacaaaactaaaacaacagcctcaatagcaaggcccatgtataggaagatctgggaagaatgtaatcaggtataaagaacaagttgaggacagcatctcagaactaaagctatgaatagcaatattgttctggaatctctctcctgtgtggtgccttgcacttgttgccagagccaagcatgctggcttaaaaaagctgcagatgactggacagtacaaaggaccctggacatgaaatgaagaaacctggatttgtgataaaatttcgccactaagttagcttaggtatgtaattttatctttctggtaatttctgcactataaatcataactgtttttgtaagttaaaatggaatggatgactcagtatttttgcctctggcaatttccctaaggaaataagtgtctgtgcaaaaaattggctacaagaattacttaattggcttattgttggtagcataaaataagaaaatgtacatgttcaacaataggtgattaaataaattgtgtatcatttagataaacagattccagtgaagccactagccataacagaagcatattttctgaaataaaatttattgtttattatatgttggtaagtgaaaaagcaagttacaaaaaggaatgtatagtatgatcttgtattttttgtgtttatgtaattgggagaacaggatacccccttttctgtatgcagatgaagaatgatatgaacaaaagatactcagcatttcaaaatctctcttataaaatcatcattaaaagtatatagtgctccatagtttttctggtaagcttgaagggaaagtagaaaagaaaccaaatacactaaaaatgagagaggacattcatgatcatgggacagccagcaaagtttttttgtggatgagaaacacaatgatgggattaacccaaaagagaaatatacttgaagtttcatgttgctgagacctggagcttcgaaactctcaccccctttttccctcacttccttttcacactttcctgccaagtggcattatagcatcagcgaacggatcacattgagcgaggcccaagatgcttctccagcctcgatgtctcaaccctgagaatggctcttggggaatgagtaataaatcagatggtgaaatctcccatggctaagtgtgacttgttccaaaagtagagcatgtttacttggataagtttcaagaaggagttttgttggctaaaaagcatgaatctctcagaaggcagtggagccaagttagaaactagatatgatcccaaagtgaaatcttccgggaaaggggctctctccttctgggaacattgtctttatcacagtgcctgtaacatagtggctccttaatcaatgtttcctttagttcttatcttctgcctgcaaggaagttttgtttaattttgtttttcatctctacttgctagccaaatgactcttcgccattctaaagtgtctctttttccatatctcctcatatgtacctacatatacacgtgtgtatacattgagttttccatcttttagtaaaatgggccgagtaattttcttatgaactgaaagagggaaatgcaggaatgtaaacttgattgtcattttttaaattagtcctcttagccctatgccttagagggagttcttttctcatggtgtgaacaacaaagcatctacttcttttgcttgggggcaaaagggtactcatgacaagattaaaagagcaaataggagaggaagggaaattctgaaaattaatgcttttataaggctgtggtgactaaccaactccatcttcagtagaatgtctctgagtcacctatgatgagcaatgatattgacaaaaagaagcattgtacacgtaacaccacctaatcacaaattacttagctaaatccttcttcccacacaacagcaattgtttcttcagaccctggaggaacaggtgctgtgggtgaactagctgcttgttcttttgttcactttgccaggcagaatcaagtgggtggattgtgaataagatcattgatgtttacttggttgctagtcgccccacgcgctcactttcctattttgcttatttaaagtaataaaacagaaaagcagaactgaagaaaattgatcactaaatgcggtttcaggtgctaagcagtcttttcattgtttttaaaaaaattttcattgaagttagggcagggagaagataatatcatctaaaggtgatacagagcacttctggcttaacgtacccttctcccaactggaattcctacaagaactttaaactgagtgagacgtttagtttcctagtcccaaatcattatgtgatgaaaaactatccagcactggctgggcacatcaggaagctacagcaagagtgaatgcaacagcggatgaagtttagagtttgaagaaaataacaatttctttcttcatattttattttttcacaactctcattatatccatagaataacaaccttaaaggggacaatacaaacataatttattctgacttttcttgattccaatgagttcccaaactctttcttgaaaaaagcaacgcaatccagtctctctctgtgtccaccctcccctgaacacccatggtctaaaaaacagtagctcatacttagctgagggttaggttcttatcagtctaagcccaatagtgtgtggcctgtgatccagttctgggccaattgggctgctaggaaatgtttccttgctgaggatgggttggggaggtgtggagaagacttgagcaagcgttcctcttccagtgggtgttgtcctgtctggatgtgacatgaggaaccaagtcatgcattttgggaactcaaggtcgcttaacctggagtatagagtttcctctcttgcaagggcagagctaaaaaatggaaagaacctgggtcctttttttatgttgttgaagttactgaaataaacagccagagctgactcatctctctcttgttgaagtaatgtattttccttattatttaaggtgtttggaatctagtttctgttccttatggcttaagaaattctaaatgtgtgcaatgatggctaaaagttatttagctacagtagagttgttcttttctttttcagttgattacgatgtaagcaatatacagctcttggaattactctgaggcaagtcatatatgtgctgggagcctcaggtttttcaactgtaaagctagagagcaattcatttatttattcagccacaaatatttattaagcacctactatgttccagatacttctaggagttgggaatacatcagtgaacaaaagtgataaaaatccctgctctcgctgtgtgtgtaatttaggagaggagacaactgataaataacatgaataaaatgaggaaagcagtatgttaaatagtaagtgccaagcagaagaaaatcagggaagaaagatataaagtgccggtgggggagggagtttgaaatcttaggattatcagtgaaggcttgactaagaaagtgactttattttgtaacgaaataagaaagtgaaagagccagcctcttgcctcttgcctttctgaggaagagtatttctagcacagtaaacagcaagtgtaaaggtcacgagacgggagcatcgctggcacattcacagaagaggaaggggagaaagtcatggggagaagagcatcaggcagaactcactttgtctctttgagtgaaagcagaaactatcagatgatttttagcagagaagtgacatgctttgacatattttaacaagtttattctggctgctgcattgagaatagacaaagagcagaagccaagaaactgttaggaggatatttcagtaatatagataacaggatgatgatttgattcaagagaggtagcagacagtattgtgagaagtggtcacattctgattatgttttgaaggaatttcaaatagaaagagaggaattaagaatgataccaagatttctggtctgatcagtggaagaattgagttatccatccttgagatatggaaagagttataagaaagggttttggtacagactatcaggtgttcagtttatgacatgttaatttggcatgcctagtagatgtataatgtagatttccaataggcagctgaatatatatgtttggagtttaggggagtgatctaagctggagagatatgtttaagaatcattaatataatttgaagccattgagattagatgcaattaccctgggagagaatgaagatgagttccaaatttaaaagtcaagctgggcatggtggcatgtgctatagtcccagctactcaggaagctgaggtagaaaggtcactggagcccagttcaaggctagcctaagcaacacagcaagaccttgtctcaaaaacagacagaaaaaaaaataatgaaaacaaaaagtcttccaaatgtaaaagtcaggttgatgaaaaaggaccagtcagagactgggaaggagcatctataaagctgggaggaaaatcaggcaaatgtattgtttgaatgacaaaagaagaatgtttaaagattgagacaatgaacaactctgtcaaatgctgctgagagatgaagtaaaaatgaggacagaaaatggatccttgatttaacaacatggtagtcattggtgacttagagaactgttctgtggagtggtaaaggtaactggagtgggtttaagagagaatgggaggagagaaatttcagacagcagtttaggcaaggctctcaaggaatctggctataaagaaatggggcactggtggatacaactagtatggaggaaattatttataatgacaaggcaaggtgaagagagttgctagagcaatacttgtgagcagaggtggtggcctttgttaggtgcatgacctatttacaaacagtaataaaagagatagcagggtgcatacacagagatgcagagattacttcatttcttgcagtgaaataagcagcaaggtcctcacctgagtgagaataggggaagaaatattggaggtgggaaaagtaaatgaagtctgaaatagttgacagaagactggaagagagaatggattagggacatatgatttttgggcagcctctggggcttacctgaggcaggtcaatggccatgaatatataacaagacctgtcagcataggtgcacgtttttccagctacattcagccttaggattatgagcatggcccaagcagataagaggatgtatccatggttgtgagtttccaagagtgtgagaaagtccaaggagcaagtgagttaggttctactagccttgtaaagagctaacttagattaagcccagactacattatgtgctagcaattgagttaggccatagtgcaaaccattatatcccaaagcagtttctaaacatctggttatagatagaaagttactataatttgtataagtatttcacaatttgtcctggtcctgcctagagactcagcaataaaaattacccaacagttcttggccattgaagactttgaaactaggacaaaataaactcattttactgtaaaatagctgcagatcttcctttaagaaattaaatagtaccatagaaacactttgtgctttttttttttttttgtagaccttgattttcttcttaaaacaaagtaaaaataatgacaagcattttagtagcaggggcccagcagaagacagctgcctaagtagcatggttttagggatgctgagaacaatccctctacaaaccaatgcccatacctgttcactggggcctgaggtgccaacagaggtgccctttggctttaagaaaggggtcaaagctggctgggcgcaatggctcacgcctgtaatcccagcacttgggaggtcaagcaggtggatcacttgagctcaggagttcgagaccagcctggccatgtctctaataaaaatacaaaaattagctgggtgtggtggcatgcacctgtaatcccagctactcaggaggctgaggcatgaggcttgaacccgggatgaggctgcactgagccaagttcgtgccactgcactccagcctggtgacagagtgagactgtcaaaaaaaaaaaaaaaaaaaaaagaaaagaaaaaaagaaagagatcaaagtcttcagtgtccacaggagccagcagcaaactcatggggcagatgtgaagtatgtgtgtgcctggtggggataggggagtgcctgctcccttctgaaacaggcagcagcttctctgactgctgctgtagtgaacacagaaccagtggggcagaccttacactttttcaaattaattaagccagaaatcttgacttttacatgacatatccaatttttaaatgttggtgacatttaaaaaaacataaaaacactttttacggacaaacaagaattttttttttctgttgtaaagcagcaaaagcctaaatgcaaatccttctggagtacaattactgcttaatctgttatcaacttttcctactccagtctgcaggagaacattctagctctcttctgagaattggttttgtctgagagaaaagcaggaatgctgtaaatgcttcctgctgctttctcaggttagggtggtttatgacagctgttgttcagttcatggacacatggtctagtacgctgatcttcattgtaatctttttgtacattctcacctttaaaaaatctgataaaaagaccacagagccatgaaaggttcatagaagtcagtagaattttattcaatgaaatcactcgaaagctgtgtcatctatgtttacccttaaattataattttttacataaaaattcaaaatttgggtgaagattaatattccttgaaaatttccttagaatatactgatttgctactacatttcatttttcctacattcagctagatgaccacttcatttggtgtctctcagccttctgctgagacatttgagtccgagtatatcctcagcattaacagtaaacctacataaagagggcagcccaacagcaaaacaagagttgtataccctcgtgagcaaagaataataacaataggaatattaatgtcagtgatcagaatagttatactgctaccatttaatttctatcaaatatcattctagtcactctgtacccattaatcctcacaatatctttattaagttggtatgtttattctcattttacaaatatggaaactgagggtcagagggaagaggtaacttgctcagagcatcaagacagtggtgagagaacccatcattaaaacaaggactatctgggtaccccttgaggcttctgttatcaaaagggcttggcctcaattcaacaactatttatcaatgatatctccattcctggccttggtttgggtttaggaatgcaatgatgaatacacagttcttgcccatggagacattatactgcagtagaggagacacaaatagaaatatattttcaaaacaatgtggttgacaggagaggtaaatacaatctattatgtaggttttgagagggaaggcaagcccagaatagggcctaggaaggtttgctgtggagcatgatgctgtacactgaatcttaggaaaaagtaagaagtcgggaaaagaagtaggggaagagactatttattctaggtaagaaacataaacaacatgaacagcataaacaggcatgtgagcaagtgtgatgtttttagcaaatcaaaagaagctgagcatccatgtatgctcaagttcaagctggggagtagcaggagctggggtgcttgcctgtatcccagaaatgataacatcaaagtgttacaaggacaggttcgtattaaaaaaaaaaaaaaaaagcagccatgtgaaggctggattggagggtacagtttagagaagcttttaggagtcttagttgttaactatattgttctcagcaacattttcccagaagagaccattgttttgctcacagagaacaattaacttgccattctcaccaagtgcaaattgttatgtactaaatgagaccagagtaggacacactgcccttgacactggccagcactatgcaggcatacatacagtacctcttctgaagaaataaagatggacgcactgtcagcagaaatcacaaatttattaactcttaaatatatcaatcagtcctttaccattatggcaagaaatatatacagtgtcccatggtaaactgcagtgtttcaaaatgatagaagataataaatgtgtaattcatttgtggtggagagaacaaatcacaatttcctcacatcttagtgcggaagacaaacttgatctacagtaatacttcaacaccacatgctaagttaaaagtgtaaaaaaaacactctacatctatttttttttctttaaatacatgtatgccacgtatagctgcttcacaaaagggtaaaagaaattaaaaagagaaaaatgaggccattattttttcacagatctcattggcaggttaacatggctcaatatatttactgtatatatttattttaaatatatatgttgttttaaattgtgtaataattatcagaaaagcttcaacccatctaccatacatccactagcaataatatctaagatgattagtaatcaacacagagaggtgagatgagagaaaagaggaagggttgtttttgttattttgtttttcttttttgcttctgctttaaaaataggcttctgaggactgtgaattactatcgttaaaataacaatgatggagattccatgcactgtaaagcacttcagggaagagaacaaaaatcacaggaattgaatcaacaaaggaaaaatgagaagcacaaagaaaacctaggacatttccctttttgttttaaactgggaaattctaactccttggaggaagacaatgatactctgattcaagagagaagctaaaaaagcacaagtcacaaagatcaagttcaaaacacttatgagaatggcaaacatttgtaagcctctctaacactagaaaactagctagtgatgatgcagaagtgaccctttcattccccaaggcggaggtgagtgcgtttgcataaaaccccctctgctatcaagttggtatcctcctggcaactgtcccaatcagtaagacgttgcagtcacaggaggaacttgcttttatcctaactttaaacaatgcaaatacctccaacatagttaggatacctaagtccaaactagagcttaagcagaattataaacctttaaaatcttgacaacatttttgtgggccctgaagatgatcaaaagtgctagtatagctaccttcaaaagacttttatttcccttttacattcattatgcaaatttcacttctattcttttctcacacactactagccagcctccccaaaaaaggaaaagggaaaaaagtaagaaaagaatggaacaaaagaaaaataagaaagcaaacgaaaggaacaaagaaacaggataaagaaaagagatcacagatttgagaaagaaaaacaattcaattcagcaaattcaccaaaacaatgtgaatatatcctaaagtgattaaactcagaaatgatgtgaatttttccagtttacacagtttgaccaaaaacagcatggctttatgtggtagcaaaccaactgattcttgcttctactttcataagtgattttgcccacatatcatcccactttaattgttaatcagcaaaactttcaatgaaaaatcatccattttaaccaggatcacaccaggaaactgaaggtgtattttttttttaccttaaaaaaaaaaaaaaaaaccaaacaaaccaaaacagattaacagcaaagagttctaaaaaatttacatttctcttacaactgtcattcagagaacaatagttcttaagtctgttaaatcttggcattaacagagaaacttgatgaagagttgtacttggaatattgtggatttttttttttgtctaatctccccctattgttttgccaacagtaatttaagtttgtgtggaacatccccgtagttgaagtgtaaacaatgtataggaaggaatatatgataagatgatgcatcacatatgcattacatgtaggaccttcacaacttcatgcactcagaaacatgcatgaagaggaggagaggacggcccagggtcaccatccaggtgccttgagaacagagaatgcagaagtggcactgttgaaatttagctgaaaggagaaagggggaggaagaaataaattatattgttttacaaaatatcatcaaattgctttgccatagatttgactaggctacagttttataacttggctaacaaatagattgaaaacactatgtataagagatgtttgcttgtgatcattacaagaagaaacatacaatgttacacaaagagagtattaaattagaagatcagtattaattattttttcacacaaagctaagctaaaaataaagagacagagacacagtcttcagtcacattattaaatctaagtatacatcttaagcattcctgtttactggacaaattagtaaatgaatataatccttttgttgaaatagacttaaaattcaagttcatccttagcttctgttattattgttagattccttgggaaatgaaacctagaagtcaatttaacaaggaatatagtctcgaaagtagagagaacatgattactctctttaattggagatctcctttgctgaaagcaacagctgggagcactatttgttaaaagctctgataaggtttagttctctgaatgaggcaaatattcacaacagcaccatacatatctgaatgcttgtaacccaagtctaagaaacaattaattaaaaacaacaacaaaagcatgaagttaattacagtcaactttcaattatcctctggaattacccattttgtgagttttaaatttcagcttgacttcctcctgtggcctgtcctcatggtcaagtaccattatactcagtcaggcacagcaaattgatttacacattcgccatagccagctgcttacagaactgcaacctcttgaaagaatggttaagacaccaaaggattctaaagcttaatataaattaagtccggataattgagagttatctgaactgacccagacataatttacttttgatgtgaaaacttcaggattctaacatgacacaatccacatgttggaaaaaattcttttcagtgtttattacctttaaaataaggattatgctaccaaatagggctgaatgttagattcaaaagctcatgcaaaattgctatgaattttcaaagaccttgtgcgtttttcattgaatattatgcaataaaaaatatcctcaaaaggaaggaaaacagccatgcagcttttcattcagctccagtcacaaagtatcacggagcaggatgttacttacaagacccatatgtgaatggttttcaggccttagatgttttgccacaaagaggtgcctcctgagaagttttctttcccatttggaatacagggtggcctattaagagaagccccatttaagccacctggcataaaatgaagttttcttgaataggcttcatcccataaacacttcagggaactgcaaaaaaacctaaacccctggtactgtatgaatgtaaccccttctatattaactggcgatttgtgctgtacctctttggggtgaaaaacacacaaaaacgggtgtcttcattatcttcatattcctcttgtgtttttctcttaattacatagctatggttttgggaataaatttcagcctattgtttggtttggtttgatttttgtccctgttgacccactttttacaaatctaacagtgatatataattattaaggctatacagaaggcctctgaaaaccactgtggtatgctaccaaactaagaaatcatgatggattctctggagtgagttgaatggctgtttgtatgaacccccattccaaatctcaaatattaacaggtgatcctggtgagagaatttggaaagagatcaacagtggacccaacttctacactgagtttaaactcttcttgttttcatctcactccactttaccaataagcctattttcaattattcctctttagttgtaaccggccttccttaccaataatgttctatcatattaaactaaatcctgatattgtacttttcttcatgatgctcatttagcttggactatccatcctcctttgctttttcagtctatgtctctaaattctactcatcatttaagattttgtccaaaattctatcttatatacaaagtgtacttccaaactgttataaacagtttactacactgttcattaactctactgtattctgaagttgatgataaactttattatatcatttttttctttagaatcaatgattggctaaatgagaatacatgtttcttgaaagcaatatcttgtactttgtgttgaatctggcacagattaagcacctaggtgattcacaataaatatgtgcctaatcgctgactggaaaagcaaatgatatctgaggtagagtggtgaggtgagaatgacattgcactacctgacaatggccttttaaatgctgtctctctaactgagctttaggggatcatctatgaaatgaaactcctgataatatattggccattttagaaactcctccctatgttttcctctgatatccccttcttctgtcaattgagaagatgaagtcacaaatattttgccttattatacaagtcctctagatttaaccctgtgagattttgatcacgtagtctctcgtcctgtctaaacctatcatatactgctctatagcaagtttcaacccacaaatggctgatctgattgatctttccagagaatcataaacctttcccgtgaaggcatttattttcatcagtgtaaccaactactagcgttaaataacatataccatgctattaacaatggaataagtagaaggagctgaccatgggtgtattaacaaagaagctgacagcctggaaatatttacttgatgggtactgttggtgaccccgagcgatgaaaatgaacattctgccactttccatcccggcggtgccacacacgagtctcttctgactgcattgtctttggcattccactgccatccatgtactgtgtgagcctaatatatgctatgcaggcggcatcatcccctaccagatgtacatgagggtttagaataatagtgtggattggtttattgcttttggacaaagctgaaagagaaaaacatgaaaagcaaaatttagtttctatgtaaaggaaactaaaaccagtaataacttcagttaggaccaatgaatgaaatgacatttattcactcactaattaattagttaattaatctactatttgtactaattgggtactgggcactgtacaaagcaaaaaaagaatgaaagtggatacagtctttattttatctggtttcctttacaggcatttatatgctctctggaaattttgattgggtgaaaaagctggagagatatatttatttacaatggaaagtggttagaaacagaaatcacaacatgaatagaagtgaagaaggcctggcccaggtgtgccaagcactgcccctgtcttttccaggaatgaactgctgggacagctgaccagggatcttgtggtggtggttgtttttgttagttggtgaagtatgtgggagaagggaaatatatcaagtttcaggtatagacatcactgtcttcaaaataaggctggtggtagcctttgaacaagcctatgaacttgtttctcatctcattctctgactcctccacatactagagtccattccatgatagtccactgtgatcatctgataaacattcaaaatgtggtgttggcacatagcctgattctggtcttccagctctttcccttgactgagtagccctcactatgctccagcctctggttttgacagtagttaccaattctaattattcagtcaccaagagatacgaggaggatttagtgcacatcacttattgatgctgtttctttcttagatcactagaaaaggttgaattgtttttggctattatccaaacatgctttccattctcagaaaacatctattcaaattatataaaatattattatagtcacctaaataccccattatgaaggaattatatttatggaacatgatatatagtgttatactgaaataggttaaaatattaatgagttaattctttcattagggatcagatggtgtcgatagagagttagttggaggaaacatgagatgctatcagaacactggaatatagggaatatgataacatttactgaaattttgttaaagagaatttatcaaatagttctttttgtttatttgtttgtaaatgtctaatgcatataagaaaaagtaactcatccaacacatcttaattcgaaaatccatgccaaggcagacattcttatcaaagcttataattactgaaagtgatgtgattatcctaatcattcctataatacatttcttttttaattcaataagatctctgcaaaaatagtaaattcccttaatgcaagatgcaaacacagcataatgtctaatgtcattaggtgtaaggaaaaagagaaggataaagggaattcctggtttacatttttcttgatgacctgaaggatttctgcaggatgaacttcttttgtcaccttctttgaaaagtggctgtttcctctgaaactaccacaagtcttaaaatttgaattgaaagatttatctgattactcaccttcattttcattttactttgaaaataagcatcacatatgcttgaaagcactcttctatgttaaatattttggcatggtgtggtttttaaaaattttttcctcctattttttctttttcttatttttaaaatttgagacagggtctcgttctgtcacccaggcaggagtccagtggcatgattatagctcactgcagcctcaatctcctgggctcaaagtgatctctcatctcagcttcccaagtagctgggactataggtgcttgtcatcatgactggttaatttttatattctttgtagagatggggtctcactatgttgctcatactggtcttgaatttctggccttaaactatcgctatcctgccacctcagcttcctaaagtgttgggattactggcatgagccagcgtgcctgcctaatttttttatatatagttttatgaaaatgtgaaataacattttttgtaactgctttatagcttatattatacattaactgcaacttgcttgaagtgtattcaatcaacattactttttttttttttttttgagatggagtttcactcttgttgcccaggcttgcgatcttggctcactgcaacttccacctcacgggttcaagcaattctcatacctcagcctcccaagtagctgggattacaggtgtgcgccaccatgcccagctaattttgtatttttagtagagatgagcctttaccatgttggtcaggctggtctcaaactcctgacctcaagtgatccacccgcctcggcccccaaagcactgggattacaggcatgagccacagtgcccagtcaacattaatttttttacaaagatattttttaaaacacaccaaaactgtaagccaagcctgacatatttttttttcaattttgaatacaaaaccattgtatggtttcaaatgctggatgaaggtaaaaactctcattgtagaaaagagcaaaataatctgcaaatttgggaaaattcagagaggtttaaaaagggcatgttattaaattaggaataaatgtaccattttcaaagtagaatcggtgaaaatccatcccttccactaaattacccaaagcttcaggttcaaaagcagtaaggcctgggtcacagatttttctgtaaaagaaaaataatgaaaacaaccaattaataggtgctttaatgtgttttgttgtttcatgtgtaaacattctgatttaccagtcactgaaggaaagagcctctaaaaacacttacatacaaaagttctatcataaaccttggcaaggtgggttgaggagcagactcttaaaaagacattttgcagagaactctgataggaacaaactaatttatccagttcaagcagatgataatacacaatattttaggaggcccctttttataatttctacttttttatttttaaggtgaattttccagtttttctaactcttgattgaggtttactattttttaaaaatgctctccaagtcctattgtccaagtgtaagacactctccaaatcctataaaactatctttgattctgaaattaaatacttctgcaataataataataataattattattatttttgagacagggtcttgctccattgcccaggctggagtgtattggtgcaatcatggctcactgcagcctcaaccttccagactcaagcaatcctcccggcttagcctccctagtagctgggagtattggcgtacagtaccatgctgggttaatttttaaatttttatttctagtagagatggggtttccttatgttgcccaggctcgtctcggactctaggcacaagtgatcctcccacctgacctcccaaagtatgggattacaggggtgatccaccatgcttagccttggaataatttttgatggaccacatatcctacattcatgtcaaacatgtatattacaattgacttgaaagaaagtatcacaccctacacttcctggcaatgtccacaagacttacatcttattattgtgtttaagtttattttatttttaaaatgaaatcaacagaaggttcaaatgctcatattggttttctttcttaatcctagaaatatgattcaataaaggggtgcacaattttaaatatttggaaaaaaccaatgagctttctttggagaaatttatttattcagtaaagaattgctgaacacttactatgtggcagatattcttcaaaacaagcaattatacaataatcaatactagaatagatgaacaggaaaggtttaagagaggaagaaaatttgagctgggctttgaagaatgagtaagagttttccaggtgtgtgggaggtggtgggcagggggaggacagcaagtgcaatggtctgctgctgtgaaaatgcagagtatgcttggggaatgatgactggttgcttgatatggaaagcagggtcactgtgttatgtgtgtaaggcccctggaaatgcagagaagaaaatatttcctttgggcctatggtgatcagggtaggcttctcagagaaggtgacaagacctggatttgaagaatgaatgggagttcacaaggtagatcaaatggagtacaaatcaaaggattttggactgtttattaatttgccccaaagggtaatacagtggatggggccacatctaatttcatagagaaattccccatttgggtggagggggagcaaaattttttaaatgttcaacagaaatacaaatttcaaaagtctaactcactgtagttcctcaaagtgcagtactgtttatagaacgtggaaccggtgttatttaaagaatacctttaaaaagtagaaatcacagtggatatcctttgtgccttaaagatgatgggggcaaggattacagtaaccttcacttcagattgcctgctgggcaggcatttttaagcttaaaatcaaatatatatagtctctttctaagaagcaaaatgggaagaacagcgttcctatggtaacaagaatttattctgccaggggctattacttcctctataaatatggtttttggttgtcattatcagtgaaccaaaatttcttactgccttacatcagtactaacataatctgggaatcactgtgccatgatggatcttcttacccagccatgaaaaagagtcagtatatttggaaatgtgtgtgtgtgtgtgtgtgtgtgtgtgtctgtctgtctgtctgtctgtctgtctgtctgtctgtctgtctgtctatctatctatctatctatctatctatctaatcatccatctaccccataaaaggctttgtattaatgaaagatccacaaagctgccatttgacatgtgggtgtgtgtgatctgaacaggtgttctaaggaccagctgacagggatccaccagtacattctaccatcccaaaagctctcgaatggaagccctgttggattagctctggctggaaagtacaaaatcaggccagattataagtctccataggcaaagatattagtgaactggtatgatcccaaggtttagcattatttaaaataccctattttaaactgagaatataggaaacatacacttttgcctggctacaattgctccctatataacagtagtatctgtttataaatttagaaagaatataaaagaagcaggaaaaaaattcatacacaattttacctctcagaggcaacttctttttaacaataacaaacacaactttttatcattccacaaggaaatgctattgcaaaaaaaaaagattttttaaaaaagagaataatcttattctttggataatcatatgtatctaacaaggatataacagcaacaagaatttttaaaaagcaggttctatggcacagctataaacaattgtttaatagggaacggttgtctctgaaaacagacttcttcttaactccaatttttactatttcttttattccaagtatgtcttattaggtcatgataaagaatggatacactcatacataagtatatgcatgtgtttatacatatatgcacacatatttaagttataagaagaagctcctgatatagtttgtcttacatttagctaatctcgtccatattttatattttgtgtttatttataactaatgataaaagtaatacttgcttatgtaaaatttgggaagaataaaaaagcaggaaaaaaattcacacataattttacctctcagaggcaacttctttttttctttttaaaatctaatttggcatgtttcattccacttttaatactttttatttatttatttgtttattttttgagaaagagtttcactcttgttgcccaggctggagtgcaatggtgcgatctcagctcaccgcaacctctgcctcctgggttcaagtgattctcctgcctcagcctcccaagtagctgggattacaggcatggaccaccacacctggctaattttgtacttttagtagagatggggtttctccatgctggtcaggctggtcttgaacttccaacctcaggtgatctgcctgccttggcctcccaaagcgctaggattacaggcgtgagacatcgcacctggcacttttaataccttttacttttttagttgtaataattatgtacatagtcttttaagtcctgcttaattttcagtaaaaacatcataaatatttttccaggtcgctagaaactcaacataaccattgtaccaaagatgatttaatgggaatggtactgttgggcatatacattgtttccaatttttcactattatgaattttgcttcagtatatatctttgttcacaaatttttgttcatgttttacataaaaaatttatacttgttaaattcttataagtagaattatagtattacagtaaagtgagactttataaaagctttcaggtatataataacagattatacaacaaaatatattactaatccccccatatctgccaccaccaccaccctgaaagtttgcacccaattgtgttttattccatggtggaggaaagtcaccattgtcctgcagtatctgcaccttgctggctatcagcagaatttacatctctgctgactttatagggagaagaggctcttgcattcaagtttgtgtatacttaattagtaaacatgaatatgcctttactagtttacttgtcatttatatttcctcctctgataatagtcagttcatgttctttacctatttttctacttttcaatcatattcacgcaatataaaaaattaaattttgatatatgttttgcaaatgtttttctaagtttgtctcttttattcttggttttttaattaaagtatacacgttttatctatttaggtataatcatattatgttctcatttatgattatatcttcagcttttggatctttctagccagagatcagattcaatctccgttttgcattttaagtctttcactggggtggaactcattagttgcatggtgtaaggagaaggccctatttaaattgaatgctttattttaacttcagcaaagtaatttccttcatagttcctatgatccaggagtttataaactttaaataagcattaaaacccattcttcaagtaaagttttccttaagatacaaacatataaaagagatgcagataaagttgagctgtactggctgaagagagaaggctgcctcatgtcacctcctaatctctttctctgccccagaacctctgcagaactgcaagggaaaacatttcttaagctgaaatgcacattttatgtactttcatatttttttgtgtgtttgctcacatgaattgctctgcctggactgaccttttctcatctggacttctgtatgtgtgatgtgggagtggttatacatctgtatatttacaaagaaatctccaatcgttggatcagaagtcaagccttctctctgtgaaatcttttttcttttcttttttgagacagggtctcactctgtcacccaggctggagtgcagtgatgtgaccatggctccatgcagcctcgacctcctgggcttaggtgatcctcctgcctcagcctcccaagtatgtgggactacaggtgtgcaccactatgcctgactaatttttaaactttttgtagaaacggggtcttgttttgtcacccaggttggtcttgaactcttggcctcaagcagtcttcccaccttggccttccaaagtgcaaggattacaggtgtgagccactgtgcctggcctctgaaatcttttctctgaaattttctctgaaatttttctctcctaggggcacttagtcatttatgaaataaaactattgttaacatatcaaaccttgaattaaatatatgtgaattcagacatgttgaataatgcattcatataaaaaatatatttaccatatgcatgaaagcaaagtaaacgtccgctactcacgtgtaggcttcaaagtccccattgttgatagcttcgatcagttgttcagtgactttgataatctcttgctttcgtgctaaaggcaaaaatatggagttgggtaagaataaaagacaaaagtcatattaaatattctttttcatttttaatttttgagatagggtctcactctgtcacccatgctggagtacagtagcgcaatcacagctccctacagccttgacctcctgggctcaagtgatcctcccacctctgcctcccaaagtgctgggattacaggtgtgatctgtgccctgccagaatctgcattttaacatgactctcaggtgacctctgagtacattcatgtttggaaagcactgctattttccatttgtttgaaaacaacagtcacctgaaaggtcggtcaaggctatgttttttaaaattagtttttactaaggctgggcaaagtggctcatgcctgtaatcccagcactttgggaggccgaggtgggcggatcacctgaggtcaggagttcaagaccagcctgacccacacggagaaacttcatctctactgaaaaaaaaatacaaaattagccgggcttggtggcgcatgcctataatcccagctacttgggaaggctgtggcaagagaattgcttgaacctgggaggtggaggttgcagtgagccgagatcacgccactgcactccagcctgggcaacaagagcaaaactccgtctcaaaaataaataaataaataaataaataaatataaaataaaataaaataaaattagtttttactaccttaacttgattggattagtaaacatatttctcttcatagttaacaagtgttattaaaaacaatcttaaaaagtatcattctaataatatgtctatcttcagagtaaagatgatatcttgcattgagatattgaactttatataattatttgcattttctcacttttctgcttgacaaactctacaaaaggatgccgacactgtgactggcctttgtttttagacaaatggcctttagtaaactctacaaattgaagaagtgacatatgaatcaatactgtagatgtaggcagataataagatgaaagcctccaggtatagctgtcaaacccaacaccaatcatgatttgtttctattcctagcccataattggtgaaattattaatagtggtttggctcaaatcctatctattcagtgaatttgtttctactgacatctgcctcaagtgttctttctcttttttgaaagcctgcagcatctgtatcactcggcaattatgcatatgctatctcttgataccttctttagtttaaaacacattattacttgttttaaattgttattaaactttctgtactgtgtaatgtgtcttccttgttaacttaaaagcttcccgagggcaaagaacattttattttcttgtatagcctaaaaagctttgttcagtgtcttttatggaatagatgctcaatgtttgtgaatttaatcaattgagactaataaacttttcttgatttcagaacactgttctcttatttataaaattactgcatgaaatattttagaaatcaaattttactggattttaagaatattgcgatattcccttaaaatcactgaacatagactgggaatcacaaaatgttacttcccatcttatcttactgaggtagtgaggctattgatcacgaagaaagctgacctcaggttttattctttattgactaaagaaaccagtttgcattttttatgaatctgatcttcatcaagcagattttaaccacaagcttaaatgcttactttcactctgaaacttcaggttacctaggtgatgacattatttaaaaataaattttctataaaccacattttacttcatcgagactatatgagactatatcataacaaatacaagtaataaactatcctataaaatgtgattaagttagtccataatatggttgctaacaatgtcaaggtctataatattaaaaaatcactatatgggttagaattcatatttagttacataattacttttcatttatataaagtaatataacacagctcctacagaagtccaaaacatttcttgcccttgctcatttgattgatgaatatcaataatacattcaacagcaaaacatagtgacagaagtggtatcagggcatgattttgtaataaggatcctgccagtgacacattttagcttaattcagttaggcaataggtgattcatctgtctgtgccctcaacagtatgaacatttggcaaaagctaatgacagctgacccgattctggaatataagggatacgggtgaggaggatctcagaaaatgagattataaaaatgtggccaccaaaacttctctctcacatgaaatcctcatttcaaactaacagatttttttttttggtctgatatacagctgataggaaaaactacagtttagaaaacatggccaatttgaaatgagcataagatcaacgtccttcgtggagcttcattagggtaggcttcagtttatagagtgtgaagagtttaggatcacttcctaaagtttctgaaagtctctgcactgcctcacaagcataatatggaattagaatcatcgggtgtatatggccatcttttactttctgaaccactgtggaaatacgcattcactcttaagtattttgcatgccacaactggcttaagggttgtcctgcataaacaaagcaacacaaattgccttctctcacttcttatgcttagaaacgatggtgcttttgctggcaggacaacaaatgggaattagccaggatgcttctgtgctgtatcaccataaaaacaatgtgactcgtttggcttaggaggggcctggaactcaggaatctttagagtgcttatttcactggggcaaaggagcttgagtgagtcacaggcggcacatgacagctgactctttaaaggaaagcagaaggctggaaatgaatcatttgtatatagtagtcagcttgttgttggaactgttgccacaagcccagcatctgacctagaggaagagcgagggtttggtgttagctagctctactctcaatcagcagtgaggttgaggaacagttactgtgtcagtggcttggacagacaagttgtgtggggagggggtccattctcatctggccttccctcttcctgaacaccaagtaataaataaccactccaaaagtcaaagtggagagcttgtgatgtgtccctaattataccacgatgaatgcagaatgtaccagtaaggtgttccctgaataccagaagcttcttccactccagagctagccatttaatcgcaggaagctgtttacctactaggtttatttctagaactgaagtgctcaagcctatactcataggacacaaagtactttctggcgatttctagattcttaggaaaaggaaaaagagaaaaccaagtgggagagatgttccaggttctgagtggaattactttccatgcaattatgcacaaagaattgggaacattttccctttcaaattcatatatttttggctcttgttctaagaggcctggaagagtaagataagggtgtgaatgatcccagtgtttgaaaacaaaataaaacccaagaactgagagtaactacataataaaacaacttacagatttcaacatttcctcaaacattagatttggttactataacaatactcaggaatgcagtgattatttcttggtttaacagataaataaagggattatgcgcattgcccaaaggtatggagtttgctgatcactccttcccaccttcttgtcttggaacactctccttttacttaactctcttgcttttctacatgttctcattctcatttgccatgttatccttctctacctggatattaaatgcttcaattccttctaaagactcaatttgagtccctctccttatctcatgctgcatccctaaagtcctgtgtacaccagtgttttaaatagtcatctatattccaatgactcccaaattgttaacctcctttctagactcttccttcagatctatgtgtcaaggctatttttgagcctccatttgggtatctcaaatggacctcaaacccaacatatactgaactgagcttaagaacttccaccactacaagcctgcttgctcttccatggatccccattttggtgaatggcaagatcatctctcagttgcataagccagaaagaaacctgaggatcatatttgactccctaaatccagcacctcaagccaatccattaagttctgttgaatttgccttcctcttctttttgactttttttcctcttcacccccactctctctgggtataagcacccatcatttcttgtccaggctctgtaacagccctctgatttagtgtttctgcaaccaattttgctcttcactattctgttctctacaatgcaaccacctctctctctctctttcttttttttaaatgcctatctcttcagataaccttctatttgaactcttctaaaaccttctcactgctctcaggataggtacctgaagagagactacaaaaccttgcgtaatctggactctgcccatctcattagactcattcagactctttgactttatcttctccaatccactcttgctcctttgttttaccaattcaaaatggacattctgcctcctattaccagccctttatatgtactgtcttctcttcttggaaaactgcaccccccccattttgctcctacttcttttatcagatctcaattcaactattatttcttcaaaaatgccttccctgggccaggcgcggtggctcatgcctgtaatctcagcacttggagaggccgaggcgggtggatcacgaggtcaagagaccatcctggccaacatggtgaaaccccgtctctgctaaaagtacaaaccttagctaggtgtggtggcacgcacatgtagtcccagctactcgggagactgaggcaggagaatcacttgaacccggtaggtggaggttgcagtgagctgagattgcaccattgcactccagcctggtgacagagcgagactttgtctcaaaaaaaagaaaaaaaaaaaaaagtcttccctgagcctcatgttaggtcaggtccccgcgatgttatgaattcatacatagctggcacctgatttttaaaagcacttagtacacttgtatttacatatttatttgcatgtaaccgattaatcagttttctctattactctagaagggtggtactgcaccattgcatctctagcagataacacagtgcatggcatataggaaatgtttaataagtatttgaatgaatagtaggtccagaacaaactcaattggtttcgattcccaatccaatgacctttttaaaatatatgatggtacattatttggtgataaccagacagcctttaagaaatataaaattgacaaatggaaataatttaagtataaagtagtatgtcttatcgtttattgacaatgacagaaaacactttttgacttgtctaaaactgatcatcgaactcctttgttttcctgacttactcatttttgctaatgaaaccacaattttgccagtctcccagctcaaaacctggggtttcttctggattcaattctttctttgtttccatatccaatcctccatggatcattctttttccttagcacttctgatgatgtttcccaggatacatccttagcctcttaattatttcatttggttactcttggcaatctcattcactcctctggctctgaccgcatgctgaagactgccaattctctatctcggagaccttaaatctttctaggctccatgctcatatttctaactgcattctaaacatctgaatttgtcctggcatttcagacccagggtgcccaaaatgaacctcagtatttttctcacaaagtctgatgcctctctggaatttctcatcttggatagtggcatcataatctactcagctgcccaaactggaagccttgctatctcctttctttttattcctcatagatctttagccattctacattcttccaactctttctcagagccatttcttcctctctaggctcactgccactactctgattcaggctctcggaagttcctgacccttcctgctcccaggtctcccacaccggcctctctcactcctcactgttgcagaatcatcactctatagaacagagctgccattgtcccccacccctttaaggtttctagtccccctcctctcatggtctagaagctgaagcccaaagttctctgttttaaagatcttcttacttttcctgctttatctcttgacactttttgtcctctagggcttttatatattctccagccacaccaaggggctcacctttcctcagctagtcctggctctttgataactgtacttttcctgccatttttccttctgccagaagctctccctcttctgcctgaaaatctttttcaataccttgctcaagtgtcactttgtctgtattgctcttcctgcgtgcttcagacccagctactttacgttactttgatcttactgcattatcacgggatgttcatatatctaactagaacttgaccagtttatagtctgaacacctagtactgagtcaacgtccataaatgcatgcatgtatgaataaatatcagtatatggttagacaatatatataaaatactgtgtacattttaaatcactagataaatgcaagtatgtagacaattatcatgtatgatagcagtttggatgtggcggtgctgagaaggcaccttggatacttcagagtctgcatcaggaccaaagtttatgaggctgcagtatttcagatgccggaatagcagcagatttaatcttaaaagtttagtaagataaaccagatacttctagtcaatgtttacatttaatatttcttttcaagagggttgagtgcaaagaaattctagtatttgagcttgagcttttcagttgtttagattttggattaatcagttcattgaagtgaaactacttgatgataagccctattgagaggtctagctgactacaatgaaacttggaccacaaaataaactgaatttatacctgcaaatgtgtcttcactgggatgtttgcagagtgtcatatgttgaaatcttttagtgaattgtgcctaaaaagcacttattcaatgatcaaaagctgtgcaattaaaattgttatatagcaacaatttttgtatcatcttaagttagcaattctatttatttactttcttaatatgtctagttctatttaatttaaatccttctttctacatttcttacaggttattgggtacttggctgtcagagacttgaaggacaaggaggttaagtgacttgctcaagtcatctagcaaattcagaggctgtgccagggttagagctttatttggctaaggttcccctctgctgttcaattcactgatctatgttcctttccagcccacagtgctttacttcaatattttgaaatcataaacttaaatgaaccacctaaatgcctttgaacttactctggcaaggtgactgactacttaattactaggctaagggtgtaattaattattacatcaatttcacacaactgggtgccccgtggttttattgtctttttccatgctgccattaacaaaattaacccttgggaatagttactattttaggcaactatacaaattatgctcttggtagttttacagaaaaaggtgcctatcaattcagttatatttggcattctctgtgcaattagcggcttgtttctctgtgactttatttttacttcactagactgatgtagcagttaatgttggggagaggaattttcataattttggcttttaaaatcaaacttatcacagattctaaagttgagtgatttaatattttattcaaatataagacatggcaattactaaatttctattcacgaatgtttactgtaaacctcttttatccagaagtcacctgttgaataacatcaacttttcaccctttaattactagaggctttcaggattaaaaaaaataaataaattattcaaaccatctttgaactttgctatataatgcagagtagtttcatagtacaaaatgatagttaactggggaagaagtaatatcagtcttagccctgttaaattgctatagcctaataataaataattaacaaatctttaagatcagaaagatctagcattgggatcatttagaataagtacaaataggtttatgttttttttagtttgcaaggatatcacgggttacagtaaaatatggtcatgttattcctaaaattacctttgaccggaaatggaaataaaatatttactattaaattaaaggaggtataaagtatttataaagattttcattaaaaaatgacttaaataaatgttttagagtctaaagaaactatgattacacagaacatttgcttatgtgaaagaattcactctagccacattaaagtaattgggtaactattctgccacccccagctgacttgcagaagctagaaatagcacagcattgtgaataccattgagtatttcaagtattaagatgttccatgaatcacataggtgtggtaccatttccagttaagagttgatgacatggaagaaaaagattttaagaaactggtcaaagactcacatcctctgctcagatttaagattataaagtctcttggcattcaagtttacacatttgcatgatcagagatgttctaagcattctctaagggtatctcttctctccactgtgtaaccaaggtgatggccacagttattttcttgaaagaaaaaaattcagacgtggaaaagagacaatgagaccaattagtcataaagttttaaaatatttggaaagtcctttttggcctttttttttttttttttttttttttttggtcatgaaagcaatccagctgcccctgggtgctgtaatgatttcaactaactctgctaatcaattttatattagtcaaaacggagcatatatctttcaggtcaagagtttatttatttatttatttgtttattttttgagaagaagttttgctcttgtcccccaggctggagtgcaaaggtgtgatctcggctcactgcaacctccacctcccgggttcaagcgattctcctgtctcagcctccagagtagctgggattacaggtgcctgccaccacacccagctaatttttgtatttttagtagagacagggtttcaccatgttggccatgctggtcttgaactcctgacctcaggtgatctgcccgcctcgacctcccaaagtgctgggattacaggcgtgagccaccgtgcctggcggagagttaatttcaaagtgttaatattctgtcctcccttcagtattaatagctagaaatataaaaagtgagaatggttaaaatcctttacagtcatgatagtaggttttaatttctttcagtgatttcagttgctgttgtttagcttacaattaatttagcttcttttcaataactgatttcatccctttatgaaaagtatactatttgaacttagtaaataatagaatttagtttattcctgggtaaattcatttatagccacattttcctgagtaaataaactggtaaatttgtgaatgctttcttggatcaagaaggcagaaagagctgaagagcatgtcctctctaccaaataagcatcatatccctttgctggttttgaataactaacaaacaaacaaacaaacaaaattccatagtatcaactgaactgttatgtccttgaatttattttttgagaaagaactaggctgactatattaagagtactcaaaatgttattatgcatccataattattgaactccaagtgatctttttaaaggtatcttccccccatcttcttgctagtgtaggctctcagtcatatttcagtgtttctcacaccaatgttgcctcaatgaggtagaagctaagcagttttaccaactaacatagtatgaatatttcaactgtaagaatgtcatttcacttctttgtgttgcatacttcttatcttattttgactcaagaagtctcttcttctggaagagactgtccagataacaaagcagatcttttactacacaggaatatgcagcagcatctccgatcattgtactttcatgttttctagcttattcttatcttcagcagctgcaaaaatagtagcttgtgctttcattacaaagtccatcactatccagtccatagctccctgaatcaataaaagataatctgcaagggcagattatcttcagtgaagtgggaagaagaaaggccaatttacaaaacatatgggaaaatcagtctcctcccattcattgtttaaaactactaaagcatctgtagtcaacagtaagtggggaactagtggaaaaaagtttataatacaaataaaataattaaggagaatttttccaatttggaaaattatgaaaaaatgatagaacctcttgatatgtcaggagtatgttgcattcatctatggcattgtagatccaaaggccagggctcaacgtaatatgtgtgcctatatgcccaactttgatgattactgtagctttctcagatgtcagaccattggactgaaaaggcacagcattgtaaatctgtgtaaatttacaatggtctgtcacaacttgcaagacttatttaggtttggaggaaaattatttatacttcccatttttaccacacacacattcacatagtgatgctgaaactgcatttgcaaaaattacgacaacgagataaatgtgacataactgactttatcttgcttttaacctcacaagctaactgcccttgctcattcctgggtgtaaaccaagccaactatgggagaaatttactttacggtttaactttaaagcaaggatgattacaggcctttcccaaaattatgccccctccttgttcaggactgaaactaccttcataaaactaataaaaggccacaaggttagaattatggtagagtcttgaatttgctaagatctatgaatagttaagcaataaccagctattgttccctagtttgcttactgatcaggagtcatgtacctggaggtcacaagatatataacttcttcaattacccctaatagataacattactaatgtaaaacctaagattggtctttgagatatttttcagacttttgcattctggtgaaccaactgatgccaccctttgtatgtgactcatacaaaggaactgactcaaccggtcctgcaacccccacccagaaactaactcagcacatgaagacagttctgacacacctatgatttcattcccaaccaatcagcagcaccctttccctagccccctgcctgccaaattatccttaacaacccaagcctccaagttctcagagaggcagatttcagaaacatgtcctgtcttcctgcttggatgccctgcaataactaaactgtttctctactgcaacatcactgtctcagtgtattggccttatctgtacagcagatgagaagaatccattgggctgtacccatgtgaatgcctataactcttccaatgtcgtcatgcatttgaaagcaatgataagactcgtaggcccaagagccatttccgtgcttagttactacattggttaaagcttactttgggaagttaaaaatatcctatcataccagaaattactaaatgattcacagtaacacatgctttttaataaaggatacctcacattggtactgtataatcagtttagctctgggatatttgcctctaaattcagcttagataattaatttaaaaattcttgttgaaatattggggcccagttggccaggtgcagtggcccatgcctgtaatcccagcactttgggaggctgaggtgaatggatcacttgaggtcaggagttcgagaccagcctggccaccatggtaaagccctatctctactaaaaatacaaaaattagccaggtgtggtggtgggtgcctgtagtcccagctactcgggaggctgaggcaggagaattgcttgaacgtgggtggtggaggttgaagtgagccgagattgtgccactgcactccagcctgggcaacagagtgagactctgtctcaaaaaaaaaaaaaaaagaatattggggcccagttttacaggtccagtaaaggtgttcttagtttaaccaatgcaactgcagtaaaaattaaatttatgagccatatatttcagaaccaacaacatattatgtattctcatttattccaacatgtattataaatgtaaattaccataaattatgaatttatttcaaaatttaatgtatagtagatacatatttgtgagtatgactccttcaaaagatgaacagtcttcaaagacaccattcaagttacttaataagtaattaatattccacacttaggaaatctgcatttatattatatgaactgagattaagacaatagtaagaattttacattaaaaaaaaactggagataacatgaaaatattgacttggaggtttcagagaggatgactactgagaatgactacaaaggttatcgctggcacttgcatagtcagattacaaccacacagcacttaccgaagtgaggttaatttaactaacccagatgatgaaattcctcaataacttacaacactgctcctgttacaaaattgtagtacagatttaaagaataccaactcaggtacagatgtttacacacatctcaaacaaatgtgtttttgttagttttattctcagtgacaggtaaacacatttcatgtttattaactcttcatatatttaaatagccctaagttccttcttaggcttctctcttcttataaagattatgagtgaagagcttctatttcttgaagagagacttaaatatacaatctcatatgctcacactcttcctacattggtcaaaataccacttaaaaaatcacaacactcttttggaagtaagttattttttctgtcattacggaccattaacctttccagaggtatttctttactgtttagtaatatgtttacatttttgtgtagcttaactttgtgtaatgtggtacaatgtttaatcagaatgctataattctgtgtgaagtggcctaggcatggagtaaaaatactctacttaaaatactcacggccccaaaacattattttctccagtggaaaacatttcctaattcaaattgtacaattgtaaaaaaaatgacatttggagcaggatttttttttctttctttttaaatttgaaaacacataatggtataagtttttgtctattatcccaacttttcctgaaatccaaattctctccataacatttaccatctgtgttttgccagacagacatgctgtaaataaccacatgcagtgatgttaataaagaaaccaatgatcctgtacacagtcaattcaaaaacaaatcataggtctttcacatttaatctgttaacttctatcaagatagttagtttcttttgaggaaacactgaaccgggtaatcacaatttctaaaagggacattatatgttatcgttcttgagatattttgcttgagaagtgtttaagtaattttgcatagatatgctcctttttaaattcacattttacttttgtggaaaacaatcagtctacatatttttcttttcctctcagcagtgataatcaagacacaggcaaaattgagccaatttttcaaaacagttgaacatatccagagataaaaggactacttcaaatgagggatgactttgagttattacttaaaacatgtttaataagtacaaaatatgtctcaactcagaattaatgtagaaacctcataattaattcattaatctattaagtgcctattatatggtactatggaggccaaaagtagtgaactaaaatactttaattgtttaaaattcataatgagttaaaagaacaccgtcatcttcacaaacactttaaaaaaaccatcagtttcgattttaaagcaaaaatgaacttgttttctgcacttgggcagctttatgtagtttgggtatttatgcacataggttggctggatgtgggtcttaacatttatacctacttatctaaaataaatgtttcagaaaatagaaacgatgtttaaaaacacacacacagttctctctggatttatggactgttttaaatcatgggccaggaattatactaggcatttaatagattgtatcactattcaacatgagtatgctctcttattgttattattattttcaggttgagccatatgaaattacttttgtaggtaaaaaatggttaggtattgacatattattattatttttgttttagagatggagtctaactctgtcgcccaggttggggtgcagtggcgggatcttggctcactgcaacctctgcctcccgggttccagcaattctcctgcctcagcctcctgagtagctgggactacaggtgcatgccgccacaccggctaatttcttttgtattttagtagagacagggtttcactgtgttgcccaggcttgtctcgaactcctgagttcaggtaatccgcccgcctcggcctcccaaagtgctagaattacaggcgtgaactaccgcacccggccagcattgacatattattatccctattgtacatatgactcagaatggtttacatgagcagtcagaatgcatattcaatggagagctgggctgggattcaaatctagtatatttgacaccaaagcgcgtcctccattccaataggaaaaaacatcctatgacttaatgctatgatatgaatgtatgcgtccctacaaagtccatgttgcaccttaataccaaacattgatggtattaacaggtggggcccttgagtggttattagaaggggactagtgcccttataaaagggcttgagggccgggtgcagtggctcacatctgtaatcccagcactttgggagaccaaggtgggcggatcacttgaggtcaggagttcgaaactagcttggcaaacatggtgaaaccttgtctctactaaaaatacaaaaattagctctgcacggtggcgggtgcctgtaatcccagctactcgggagtctgaggcaggataattgcttgaacctagcaggcggaggttgcagtgagctgagattgtgccactgcactccaacctgggtgacagggtgagactcctcttcaaaaacaaaaaaagggcttgagggattggctagtcccttccattccttctgccatgtgaagacacagcaagaggtgccatttttaaagcagagagcaagcgttcaccagacatcaagtctgctggcaccttgatcttagactttccagcctccaaaactgtgaaaaataaatttctactatttataaattacccagtctgtgatattttgttatagcatcacaaatggactaagacacttttaaaacatgcattttcggtgtttttaactcctaaattatggagcgaggtaattatatgtacaaaaacctacacagaaaaagttgtaaactgatcacaatttcaggagaattccgatcattttagtggctgctaggacatgtcatggttggtatccactatgcttccttcctctaccaattaaatatttattattcccactattgcccaacactattctagatactatgaatatggctataaacaaaacagacaaaaatctctgctctacagaaacttacattttagtagggggaagaggaacaggaaacaagtaaaatagatatttcagataataaatataaagagaaaagtaaaacaggagaatggggagtgctggatttggagggatgtaaattttcattttattttattttttgagacagagtctcactctgctgcccaggctggagtgcagtggtgccatctcagttcactgcaacctctgcctcccaagttccagtgattcttgtgcctcagcctcccaagtagctgagattacaggcatgcaccaccacacctggctaattttgttgtatttttagtagagatggggttttgtcatgttggccaggctggtctcaaaaactcctggcctcaagtgatctgcctgcctcccaaagtgctgggattacaggcatgaaccaccatgcccagtctggagggatgtaatttaaaataaggtagtaaaagatctcacagagagggtaacttttgataacatttggtcagagacttaaaaagagaaagggcagtaagccacatggaaatgtgtatcaggacataccagacatggaatagtaagtgcaaggccctgtggcaggaacctgcttgatacatttcagaaacagtgttcctgatgcacatataataataggacattaagtcagatggcaaggcaaggcatgtctgaaggagccctggtcatggtaggccttttaatagattctgatgtctttggcagccactggagaatacagagcaagagcagcacatgatctaatgtatttttgaaagtgtaactctattctctgttgagaatagactgtaagcagaagcaggtcaatggctaagaagctatgtcaataatatcagcaaaagatgattatatcttaagttagagtgatggcaatggagttggtgagcagcagtcaattccaaaaaaaagtgtgcattttgaagaactagtaggattttctgagaccgcatgtggggtataagcaaaactaaggagacaaagaaattaaaagaaactgaggagacaaagaaagactaaggatgatgatgaaggtgtgttaaaagcactagaatataacatagtcatatcaattcagttttcttagatgcatttgaacacaaacatattaaaaatggttgagacatactatacaggagtattgcaatgagtaatgcagtagtgcagactgcactgatagtactatggaagtgaggagaaatgaaagagaaatgttctttggaggtgacatttaaaaatataacttaatctataacttatattaaataaaatagttgtatagagaggttttatatttgtttttaaagaaaacacaattgagtagtttggaaatgttcagaactcatcacagattttaaattttgttctaatctaaagagacgaaatcaaacatccaaaggtatttgcatattgcaaagaatttcctttggatactgaagtagtcacatatatgtaatcagtgggataatatagctttggcagagaagttagtttcaccacagtaaaataaatcatagcaatgccaatacttaaatcagtctttttgtactaaacatgttgctcactttcatataatggattggcaaactctgctcaacaacgttggccaagggaaaaatgttacgctattccattttaaaagaaataaagacagactacctaattcactgagtttcaaaggcaagatagtttatccactcatgtactctggaagaaactttaacatgtaataaaattttaatgcaaaaaatagctattcactggaatgggaaatgcactagcagatataatttcattgaagaggatactataaaactaaaaactcccttaggaaaaagctaagccttttcagcctcagtctattttactatattcagcacacagaaggtgctcaatctttttttcttgtttttaaatgaatgaatccaagtatttcaaatagaggtctctttgttaggcattacatcatgtgttacattcatctgaagcattctgtgtttgttcacatatgatagcagctatatccttatgcttctttttttttttttgagacagagttttgcttttgtcgcgcaggctggagtgcagtggcacaatctcggctcacttcaacctccgcctcccgggttcaagcgattctcttgcctcagcctcctgagtagctgggattacaagcatgcaccaccacacccggctaattttcgtgttttgagtagagatgggttttcaccacattggccaggttggtctcaaactccggaccccaggtgatccacccgcctcagcctcccaaagtgctgggattataggtgtgagccaccgtgcctggccgtatttatttttttaatgcacatattatttcttgttttagccactgcactccagcctggatgacagagagagaccctgtctctaaaaaataaaaaaatgagaaaacagtaaaaggtcaaaatcagaagcagaaatacataagggaactaatgtggaaggtgtaaagaaaatgcccaatttttatttaaatgaaaaaggggtgcatctatgagaatgtctgtttccatataagcaataattggttaagtcaagtaaacagagtcactttatggatattttactaagaatctgaattttgtgttaggtagggaagataccgagagactcatgaaatctgtggggcattctgaaacaaagaatttaattacagacttgttgaaaattacacattttacacaacaagctaagacctttccctatatacccattctatccaaacttccctttcttacccactcccatcctgggtcctggttccattgtgatattcacaagcctcatcccttctacccagccatggaatttagtaacccaatgtctaattcctaaagagcaatttatagtcctttttccacttctcttatagatgactagtccaggaatagctttaaaatgtctctatctctctctaagaatgagtctagatccctaattcctgtcaaagtgcttgatcttctctgaaaggaggccattagggctagtatgattccagatctctgcttatatgattccagatctcaggacattgcaaacatagttgcaatgtcctgagtcccttctttattgtatttcttgattttacaagcttgctgtacagattaaatgagattttttaaaaaagccctaaaacatagtggtaaaatgttttacaaatacaatggtacagcattttatatatagatgcaagacaccaattggttctattcagtagaattaacttcacaaaaactgacaaataacatgctgttatcaatcaagtcaacacattcctttatagccttagagctaaactttataagcagaaatggttttaaggttctttgggggctctttacaaaagataagctattatcctgaattatgtttcatctttcctcattatttaggacctcatacctgatcccaggagcaaaagatgattcctgcagatgtaagattagactgtgctacctaacttggaagtcttcatgtttgatagaaaacctccctggcaagtgtctttgccactaacctttctggaatacttttacatattattaaatgcatacgatataatattggagtaatgtgagggctgagggattccataaatccccacgtggttcagtgcagtggttcaaagcatgatcccagctcctgttaaagcacttagtggttatatgatttaacctctctaagcttcagattgttcttttgaaagactgggttaataagacctacttaacaaatggagtttttaatcaggataatgtaaggtaaagtctttagctactctgtgatcatttttatcccaagggtaagtctttggtagaaactatgagccttgtttattagctatttctgcccactaaaatctaactttcatgaaagttgaaatcctatctatgttgttgcctctgaatatccagcgcttttaacagggcttggcactcaatagtccctcactaaatatttgctgaaagagtaacttactaaataaatgtaaaaatgatcagcaaatttcttcatgcctacttgtcctttatcattagcctacaaacttgatctagactcattcatcctaaaacataaacaaaacaaaactcaaccctcccttgaccatgtatctccctttagacatagtcttaaaactggtctaaccatctttggtcttatagccttcaaatacatatgccacagaatcaccagagtgttctacctatggacatcttaccacatctttcctctgcttaaaactttctgatattcctcaggtgcttggtacattatcttgcagaatcatccttgtctatgatgtatgcctctcatctcttaatattagatcagctcaagctccttcatatggctcaatgctcccataactagcaccttccctcctctcaagcttgatctgctaccactctccaacttgcatttcattcttcagtaatatcctgactgcctgcaatacctcagacataccatgctttgtttctgtgccttctattggtaatgtttctcctctcgcaccttcttcacctggttaatagtaccttcccctttaaagctaagttcaggagttttatctttgaggagtcctttcagaatgaccattggtgaagagatatgaagagtgaatgaactctctcagattagaccagctttctataaactcaattttcagaagaaagtcacaaaaaagagattaagtagttcctcctttgatttttttttttttaagagacagagtctagctctgtcatccaggctggagtgagtgcagtagtgcagtcatagctcgctgtggtattgaactcctggcctcctcttgcctcagcctctcgagtaggtgggactacaggtgtgtgccaccatgcctaatttttataaattctttttttgtagagatggggtcttgttatattgccgaggctggtctcaaactcctggcctcaaaagatcctctggcctcagcatcccaaaatgttgggattacgggtatgagccactgggcttgggtgattataatcttttcttacctcagaactattaagaaaactcaatatttcagttttaatatattgcagaactttggaaaggaaaactcacagcaaagacacagacagaaaatgtgtgccattacatctatccaatacattgattgcatttttactttatggccaaaaatacctccaagtacaagaatattaagcctgaatccttggcatgtttatgtttttcttatacccaatctctgcttcctgatgctatacttacatgatagccaatgctgttaaattattttttaatataacaacaaagcttggaaatgtttaggaaagctgccttgttgagtttccctccctggactgaacacaactattgtagtttagttaagtgctattgatcacgattcactctctattgatttatactagaatacagtccctataatccactcagaattagcccagtccgtttgaaactctctcaatcatttgtgtctttgcctgcaacattatcttgtagaatcatctttcttttctaaatcttctagagtctagttagaagactatacattacaggtgttcataaaatatttgttgcactaaattgaaaagtgaaaataccactgtttcggatgtgaaaaataaaaattctttatttctacacaagctctttcattaagctcctcactgaataatgtcttctctgctttcacttgctaatatcttgcttttccttactttatcatctatcatattagcttgagataaaatcacctgtaacctggtgggatattaaaattgcacaggattgagattaatttcttaaatactttagacctaattcctcctgaccaaatcaagggggttatagcagaaatccatagcagaaaataaaattagggccactccacttactcacaaaaagaatcatgatatagacatataactttacataatttatagatatatttattggtataaaataatacaaactcagcaaaggagacattatttcactcaagcaattattttactctaataaataatttcagaattacataaaattcatagttaagaaaaacatagcaaataattaggatttaacttctatatagaaatgaatgagctcaaatattaatttaattttagatattaaagaaattttgtatggaaactttagaaacataaaatttgacctcataataattctcactggaatgtgtttaaagtagtaactttatagtcctatagtgctattgataacattttggatattcaggttggtgaacaccattttttcccagttttaataagatttcctaaaactgtagcagtgtattgtttctttaaactttgagttaaatgtctttctgtgactgcttgaatagtttatattattaacatctaattgttttataataatatgtattagaatgtatcattttatataaagagatcttacaataatctattaatagtattgcatcacagtagagtagaaaaagagcttaaaagtctgtattattgatttcaatatctacattctgctgttatgaggaaacctgagccacaggtaaattatgtaacttgctcaaatatagatttcagattcaaatcagatccttgctgacattttatattttacatcacttaaaaaaagtgataaagccataatctgaaaaaataaagaagatagaaggaataatattttaaaatttacacaaaccttagatttagtagcttattaaattggacaatttttgttaggtaatgggaaaaaaatagatacatgaacaaaaatgagaaagttttataatcaacatttatgtaactatattataaagtaaattatatttggataactatgaaatttttgattacacaaagtgtgagtctgattacctcttgtatttttaactcccacataaagtaatatctatgaatagttaacccatttatgctggaggttgcaattttttgaatttttgcgtgagtggaaaatcagaccttagcgatgaccttgagcagtaggatataaataactctcacatgcttagcgtttcgataatggaacagtaggtataagtgggtaaatgtcaggtttttaaactctgaattcttaaagttaattcttaaagtgaattcacagtttaaaaactgattgatagctcaatcaaagtttagaatctgatggaagaaatcttacaacatatatatgcctttagagtttatgtagttttttataaaacaatgctacattatttttgctgtggatagttctaaaactcattacagggtttcacaaactcacaagaaaagctatttatagaaattttgagcagaaaaactttattactatagagtgagctgatgttttcctaatgttaaaatgagaagttacatgtttttgtttgttggttccatttgtcttgattttggaccttgttttaaaatggggttggcaacagtttgaccctgtattttgttagcagagctaaacaagcttgaggttatcactgaaaacttaggataacttggcaggactcaagcaataaagagaaaaattgagtatagaggtaaaatagaagaaatatataaaaatagagaaaatgaaactgtgttacattagtggtggaatagaataaattctgcatcagtcatataagttactaattctgatacaacacttaaaaaatcagcaggtagtatatgcggacagtaatttttcttttttttttattatactttaagttttagggtacatgtgcacatcgtgcaggttagttacatatgtatacatgtgccatgctggtgcgctgcacccactaactcgtcatctagcattaggtatatctcccgatgctatccctcccccctccccccaccccacaacagtccccagagtgtgatagtccccttcctgtgtctatgtgatctcatagttcaattcccacctatgagtgagaatatgcggtgtttggtttttttgttcttgcgatagtttactgagaatgatgatttccaatttcatccatgtccctacaaaggacatgaactcatcatttttttatggctgcaaagaattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatacacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttgtttttttcttgtaaatgtgtttgagttcattgtagattctggatattagccctttgtcagatgagaaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcttatgtcgtgaatggtaatgcctaggttttcttctaggggttttatggttttaggtctaacgtttaagtctttaatccatcttgaattgatttttgtacaaggtgtaaggaagggatccagtttcagctttctacatatggctagccagttttcccagcaccatttattcaatagggaatcctttccccattgcttgtttttctcaggtttgtcaaagatcagatagttgtagatatgcggcgttatttctgagggctctgttctgttccattgatctatatctctgttttggtaccagtaccacgctgttttggttactgtagccttgtagtatagtttgaagtcaggtagtgtgatgcctccagctttgttctcttggcttaggactgacttggcgatgcgggctctgttttggttcatatgaactttaaagtagttttttccaattctgtgaagaaaggcattggtagcttcatgaggatggcattgaatctgtaaattaccttgggcagtatggtcattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcaggatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaggtttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtgtatatgctggattacatttattgatttgcgtatattgaaccagccttgcatcccagggatgaagcccacttgatcatggtggataagctttttgacgtgctgctggattcgttttgccagtattttattgaggatttttgcatcaatgttcatcaaggatattggtctaaaattctctttttttgttgtgtctctgcctggctttggtatcagaatgatgttggcctcaaaatgagttagggaggattccctctttttctattgattggaatagtttcagaaggaatggtaccagttcctcctcgtacctctggtagaattcggctgtgaatccatctggtcctggactctttttggttggtaaactattgattattgccacaatttcagagcctgttattggtctattcagagattcaacttcttcctggtttagtcttgggagggtgtatgtgtccaggaatttatccatttcttctagattttctagtttatttgcgtagagctgtttgtagtattctctgatggtagtttctatttctgtgggatcggtggtgatatcccctttatcattttttattgcgtctatttgattcttctctctttttttctttattagtcttcctagcggtctatcaattttgttgatcctttcaaaaaaccagctcctggattcattaattttttaaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctctttttggcatttagtgctataaatttccctctacacactgctttgaatgtgtcccagagattctggtatgttgtgtctttgttctcgttggtttcaaagaacatctttatttctgccttcatttcactatgtacccagtagtcattcaggagcaggttgttcagtttccatgtagttgagcggttttgagtgagattcttaatcctgagatcgagtttgattgcactgtggtctgagagatagtttgttataatttctgttcttttacatttgctgaggagagcttcacttccaactatgtggtcaattttggaataggtgtggtgtggtgctgaaaaaaatgtatattctgttgatttggggtggagagttctgtagatgtctattaggtccacttggtgcagagctgagttcaattcctggttatccttgttgactttctgtctcgttgatctgtctaatgttgagagtggggtgttaaagtctcccattattaatgtgtgggagtctaagtttctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagtgaatattgttatgtgtgaatttgatcctgtcattatgatgttagctggttattttgctcgttagttgatgcagtttcttcctagtctcgatggtctttacatttaggcatgattttgcagtggctggtaccggttgttcctttccatgtttagtgcttccttcaggaactcttgtaaggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccctactctcttctggcttgtagggtttctgccgagagatcagctgttagtctgatgggcttccctttgagggtgacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgccagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttcttgcttcatttcattcatttcatcttccatcactgacaccctttcttccagttgatcgcatcggctcctgaggcttctgcattcttcacgtagttcttgagccttggttttcagctccatcagctcctttaagcacttctctgtattggttattctagttataccttcttctaaatttttttcaaagttttcaacttctttgcctttggtttgaatgtcctcccgtagctcagagtaatttgatcatctgaagccttctctcagctcgtcaaagtcattctccatccagctttgttccgttgctggtgaggaactgcgttcctttggaggaggagaggcactctgctttttagagtttccagtttttcttttctgttttttccccaactttgtggttttatctacttttggtctttgatgatggtgatatacagatggacttctggtgtggaagtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaggcagtctgcctgttctcagatctccagctgcgtgctgggagaaccactgctctcttcaaagctgtcagacagggacatttaagtctgcagagattactgctgtctttttgtttgtctgtgtcctgcccccagaggtggagcctacagaggcaggcaggcctccttgagctgtggtgggctccacccagttcgagcttcccggctgctttgtttacctaaggaagcctgggcaatggcgggcgcccctcccccagcctcgctgccgccttgcagtttgatctcagactgctgtgctagcaatcagggagactccgtgggcgtaggaccctccgagccaggtgcgggatataatctcctggtgcgccgttttttaagcccgtcggaaaagcgcagtattccggtaggagtgacccgattttccaggtcccgtctgtaacccctttctttgactcagaaagggaactccctgaccccttgcgcttcccaagtgaggcaatgccttgccctgcttcggctcacgcacggtgcgcgcacccactgacctgcgcccactgtgtggcactccctagtgagatgaacccggtacctcagatggaaatgcagaaatcacccgtcttctgcgtcgctcaagctgggagctgtagaccagagttgttcctatttggccatcttggctcctccccccagtaatttttctaagtaaacttgttgtaaaatcaaattttggattagaaacctgaaagaagttattatacactacactacagtttcctctaagacatttttaacctaatggaatgacataattatcaaaagtccctcaataaaatacccaagagtttcttaatttgcagatttttctggaagtgagaaatgtatgcaagacaagtcctgaaatataaattacatgtagataccaagaagatcagtaccatgagatcatctgccttaggaaatcccacacagaaaagaaggttttcagtgatcaaacagaacttaagaatagttgaatctgggtaatcagtcatcatactattcactaatgtacatatttatagaagacccacacagagagctcattaatcaagtgattctataaattagctgagaccacgatatccaggtcatcaaacatgaatcaccattcaagtaataagggtgccaacaactttgtccttaattgagacttttgcaaacatcctcattactactacctagtaatcaggaaaagtaaaaaggaattcaagaaggatgaagtctccacacacagtctcatagccatagaatctgcttgttgtaaagggctccactttcctagatgtgtaagaaggatgaaatgcagcaagagatccaagctcgtggtgaatggtgagctgaagtgagatactggaaacaggatggtgacagaaatgacacaagggcatacaggagcccaacttcaacaggtgctgcacaagaatgctgggaaacataagcagatggaccatatggacatgtacccatcaggaggaagtgggtgactctgaacaatggtgctggatgggttatgaggcggagaggcattgcggcatacagcgacaggtcctgcaaactgtggctacagccacaaaccaaaggacggtcttcacatgtatacagtgtggaaagaactactgctacacatcactgactctaggcacacccacacccctggcgaggagtgcagtttgtactgttaactgctaattaagagctaatgatgacagctgttggataacaccttaaatcaatggaagtagctgttttactggaaattgattaaaaatggaaatgactatttcaacaatttttggcctaaagaattgtatattttgaaaacaccagttagttgtaagaagaaaactttttttcttatataggatgggcagttgttaccacagtgcttccatgatggtaattatgctttattgggactcccatttgcttttttttttttttttttttaaagcaaagtctcactctgtcacccaggctggagtgcagaggcacaatctcggctcactgcaatctccacccaccgggttcaagtgattctcatgcctcagcctcccgagttgctgggattacaggcgcgtaccacagtgcccagctaatttttgtatttttagtggagacagggtttcaccatgtcggtcaggctagtcttggactcctgacctcaagggatctgcctgcctcagcctccgaaagtgctgggattacaggtatgagccaccactcccagactcccatttgcttttaaactattagtaactctccatgacactgagtttgctgctgagtttcctgacatagcatcatcagagataatatttggttttaaacactgaacaaaattagaaagctgctcaagaggtcaacactagggtgtcaacacattgccttggagaaagaaaacaatgaactctggaagctttttaaaaagaagagttgtaaaacaatgccagtcccttgggatgattacgagcttgggaagaaaaatgtggttagagctaaatgttgaaggtttttaagaaaaaggaaataaaagaacttttagatttaaaaaaatgtatttattttgggtctcacttttttcctgggtttcactgagtttttttttttttaggtaaaacatgcatatatgttgggtttcactaatttttcttgatagttattgtattaagtaagataaatgggcctacattatagcataacaagattcatataaagggtaggaaacagcattttgactctggtgcattcaaatctcttgaacatggctagttcaaaaagagaagcacatggaagtcaggtaaagagaagggattcaataaatatttgctgaatgaagaaacagcctagacacaattcaaaagtattacacagactggggacatgatttctcaatggaaactaattagaagagctgaaggaaaatgggcctttaaatcttggctttctaaggtgctccagactgaggaaccattaatctctgactacttttgctttcttttatctttctttgagaacagctggccttgtctgccttttcccattcaaagacgccagaaagaaaaactttgttgttagtttacctcatttcttcctttgaccgggttaccacagtgtttaatcccctcctccagcaactccatgtttctttacattggagaggacacagaagctgtccctgccaggttagtccttggggatggggcagaatgtgcactgccttggtatgggaggcatgtgacatggtattcaaggaatcatataccaccataaaacaatgtaagtctaggtgctggtgttagatgcactatagctgggacagccagcagcaatgggtagagcaagtgctcgcatgcagaagtatgtatgggggtatgcctttaagaatatgtcaaaaagtgtggtgtctcactgatcacaatgttgtctacagaaaagagaaggttgaaaagtatgtgtgtggaagacacagttttgtagatatgacatggttttgtagatgggatacagttttggtcagattatttaactgatagtaattgtgagttcttggatgttagttatagaatgttagatataggtaaattttggtttcaacagagctggacaataaacacattccctaccaagctactgagagccacagcaattctaaagtaaaaataagagagcataattattcacatatagggtctttcttgaggaccatgcactgataaatggagagattcccacacaaacagatcatcagcataataaataatttaaaatcacttaagaccattttatctaccacttgtcccagtaaaaatgatggggcctaggcaatctttcaaagtgtcttctagtcttaaaggtttctgatatcattcaatattaaaagggttagtctccagaaggctgtctgggtcttacagagaacacaaatgagtcctaatgggctatggttatgacatttttggccagatccacaccagcaaaattaagcagaaacttaaataatgtatttattaaggtaataaagctaagcactttgggttaaacgatcaactggacatttcttttgatctcaatatgatgctgaattcctctaatacttgtatacagactcaatgtaattataaatacaaatactatctcaatttatgaaatcccagaggcaagatgaaacccatatcattgttatgatttgaattggagaactgttttctaagaactgatattattatttcattttatcaaaaataaattacaaactacaaggtaacactgacaggaactctgtttatacattaatgtttacatagattaatagcaatgatcctgaaccaatacttagtacagttgagtgccaaattcaggtgagaaagaccacttattaaaacccttctcatgattacgttccttggcagatgaactgcatatagtaaggtgctggtattctcctaattttatttggttatttaaagattcagtttctccagtggacaatgaacaagttttcttagtcttgctcaagggaagaatgtgaaaattcatatgaaacatttagcttagcttaaagagctaatgaatccaaaacacaaagataatgcttcctgaatcagtgggaaagctaaatggcatatctatttatttggctaaaaaaaaagaatatttttatctaatatgactggtatcaatgattcataaaactacttcagttcaaattttagcttaagtgcaaagagtgagatgaatagacctactaaataaaattcttgacacagctatctacctttccactgtaaaaaatgactgactacctctagcagagttaggtcagtgtgcttagttatataaatagagagtacactttaacagcatcagctgttctattcaaacaaaaaggaaaaagtcagcagagctgactgccaagttgtgatctacagccatttttatttcctaaattgaccccacgtctccttgacctgagaatttccaaatcctttattctaaaatatgaatacaactttacaagactttattgtattaacactacctttagaattaaagcttatggtgatactattaggtcagtaatcttttcagatgaggtttaattaatttatggatcattgctcccaatttatatttcttttcctttaatatttctgtttcaaatatcctactgttaccgctgtttgtcagaatatcttctagacaactggtctatagagactgtagttatatataatgaattacaaaaacaacataaaactgcaaatgcaattgatacaaaagtaatacttctaaaacagtgatgtggccaaaggaggtgacctaactgcaaatgtgtgttcagtatgtgtgtgcaggggcactgagaagatgtctgtagaaacactaccaatgactcatacatgtagctaaaagaaccttggcaaccaaagtgaatggaggtcaagaatacctttggaatgtacacaaaaagctaggataaaaaggcggccaaatagaaaattctactgatattatttgagatgactaaaagttaaaaagttatttttatactgtatccttgaatataaattgttttccagataggttttatgaatgtacccaatgtgtatacattttatattactttttgactgacaaatttacaatttgttatgttcctataactagtaactcattattagttgtcattactgcaatgtgctagaatatgctacatgtctacagttcaaaatatataaaagaatatgtaggaaaaatgacaaaagtaacatattgttgaaataattatgtacttataaaaatattttttactcataaataaaatatttttgtgctttaggataggcctacttcctaaacttattagttatttgaagcactttttttttcatatatatatgtgaagctctgaggtaggattttccatttctggttaaatcatacctttcacatcttcatcctcaattgttgtatttgaactctcagttgactcctgatgagaagaaaacacatttttaggttgcacgcaatgaatagcttgatttcctccttaaaaattggctagtgacatacatatcatgcaaaattcttcagcaggctatgtgcatatgctgacatgcaaatggacaaacacattaagtggtttttaacagaaataaaatgtctgatgctgcaaacatttcaaacggagtactctggttgcctaatctccgaagctgtataaatccaggtgatttgtagaagcagcggaagtatgcagtttattttagaaactgtgtaaggatgtgttttgtgttacagtgccctataaggtttgctttttctgtgtgtctacaagcaattgaatatgttagccgaatgaatttgatacttaaaatagaaaaaatttctattcccaattaattaatcaataaagagtaccttctttgcgtcaggcactatgttaaggcctgtatgccttacacctttatagggagagaaagcatttcaccgcatcatttaatgaagaagctaagggggttaagctgagatatgctgaaagtacttttgagaagaattttcatgtttgtcctcagcacaatggaattataatgaataatttactttcaaggacaattagacttttttcattcttttcaaaaatagcaactggctgttattgataagaaacctactccataataaaaagacaaagctctttctttgtaaaactacaaattaagtggaagattgttaagcacacttaaaagtacactgtaactgccagaattaagatacatttcttaaaatggtgtgataaatgtgctcattaataatgtatgagtaaaatattttctagcaaataaattttgcaatattcataagaaagacatagttttctacttggaatgattaaatgctagagccaaaaataactggaaacaaacttccaatcaatagctcagtaatggaaaacagattctggaaaataatgtaaacaccagccagtatcattttagagattcagtattcaaaaaagtgatcaatttatataaatatcatatacaatatttaaaccaagggaaaaactaattaaaggtgtacccagagtctccatacacacaaaaccaaagaaaggaatcttcatgcatttcttaatgtgacctagtattcaaatgtaagctgaaaatgaaggtaaacccatgcactgtaaaattaaactaattcatgtcagcaagaaatatcatgcagcaactcttacaaatgatatagctagaactactgaagtgtccattccagctgttatgcttggcgtttcattggctaatgctattaaaaaaattgttctcatatgtgatggtcctgactacctcaaggcttttcgggacctagaccatttgcagtgtcatgactataaaataaatctcatattaaagaacataacacttcatgttttttactttaatggttttaatattgatcaattaaatgttaaaccagagaggaaatgtgttttctgagtcttaagataaaatgtgctttctaagtcttaaacatcattgataagagtatggagaagatgcatgactatatctaatatttgagaaaagtttagtattttttcttcccttagagatataataatatatgaaaagtaagaaattggacacatggaatacattcagaaaaggtctttcatcctatagacatgtatgctagtgctgttatttagttaacatgctatacaaataatttacaatgtataggaaacatttagtcttctttcaacctaagtagttaaacccctgttactggaatatatattactcaacaacaaacatatttcacaaaaagtgaaactccttgattcacctcaaattcatgccaaacaacaacaacaacaacaacaataacaacaataacaacatcatcaccaacaaggaattaagaaaccaaaaaccaaaaaaaaaaaaaacaccactctgacaacagaatagaataaaactcaaaagtaacactaaacaaaaaaaaaaacctataaagtcaagttgatatttttgaagacaatggaatattgccagaaattctaaaatatcatgcacaatatatctacagtacaaagcacaaagtcatggggaaaaaaatgaccagatggaattgcttaagacacacagtcatcttgacataaagacttcattcatgtttagcctgacttttattgactcatggtaacattagtttctctttcaagatgtcattcatttttatttgcaagaagtatgtccatagttctagataaattaggcccaaaaggaagtgtggtagaaaatggttagaattttctttcctatttttagataacgaattaatttttttgaatatttgatgagatgtatagtcttgttaaagcaagatgatgttgattctttctgaataccttgtttccatcagggttgtggattacagtagtttggggctcctgagtgagaacaaaatagagaaagaaacagttcgcattggtaagtacattctttctagtgtgaaggacagagcagagtgagccagctgacaaaatgaaatagtgacaagagctaaagcgatgttaactgctgtcagagttgcagctgacaatatctctgatgaaagatctccctggcgaggccatgagataggaacctccctacccagaagcagcatgcaaaagaccttattcttgatcagcattcaaacaaggctttgatatttagagatctgaagaggcactcactgtttcacttaatcctatgctttcctttcttctttaatgagtggcctgtgaacgtctgtcccatagagaactggccaaggacactggagctaaaactctgagatgatttcaaattctcagagaagatattttttcagttatattggtttgaaactcgattatggtgtcattaattaatacgtaactgaatacccttataaaatctagagccattggacaacacttaaaaaaagactatactaaagaatccatttcaaaagaccataaaaaaattttaaggaacatttaaaaagtttaagggactaatcatgaactagaactaatctactaatctagaactaatcatgtaatcactataatttgaggcatactgctattaaatcctgtattaattcatatctaaaaaacttctactttatggactatatatacaggatatctggctataaagtcatgcttttttatgaagaaagtatgggttttctattgttttctatcagaaagcaaagaaatattcccaagtggagaataacattcaaataactgatgtaaaaaaagattcaatatgcatacatcagtgacatgcttggcactttcattgtgtgatatcttggcaatggggaggtactgcaacccactgggagttctcaatcatggacactcccccaccactacagtttacactgctgtaatattgagagacatatctcctgcttccattctccctttcccttggctacagctgtgatcaacattgttttttactagtagataacctgttattttgatgtgtcctccttttaaatgtttttaaatggagcctcatggttaactcaagtgaaatgattccttaacatttttaaatttatttaaaataacagtatgagaagagcaaataattgaaaaacatttctgaaaatcataaatcaaaatatgaaacagtttagggaaaatgttatggaactcagcactgaatgacagtattcaaattctgaattttaacataataccatctcaaagtgttagactaatttagtcgttaattgtgtggatttgattgagatagacataactggtttccactgataattcaaacctctattctttgcagtttcattctttggattaaagtgaaacagtgaaaatttaatttaaaacataataaacagaaagctctaaattatccagtgcctctttatctcagaaagtgaagtcttacaaagccctgttgtgttttaataagagggaaacgagaactctgaataaggtctactttcatgttgtctagcaacaatcccattagctctccttgatgtaagcatttgcatcatgaaaagaagaaaccattgtttgcataatctagaactatcatcatcagaagagctaagagcaaccaaagcgctgtattttgaatgcagcatgcagtaattccaactacagagaccacagctatcagtacaatgttcaacaacgaaatgagataatctcatgttagaacacactgcttgacaactaacttaaccaaaaaaaaccaaaagaaatgaacttggtcatatcatagaaagcaaaaaaaaaaaaaaacaaaacccaacacccaacgaaataaaatatttatatatatgtatctatatagtgaaagcaaatgagagaaaccacaaaaaaaaaaaaatgtaaagaacttaagaagggttacaaagagtccaggtataccagcgctggggtaggaatattttctttggggctggttaccacgttggctttgttgtttatctgtgggtatgcagaaaatagaaacagagatgccttaaaccccttggtagccaatgtctctagatgcagcatgtctacatagagatgtagacatgaagataaagagccactgaagatgaacgtgaaagacatggtgatgactgacaggaatgatgatcgctagtctccgatggtcacacacaggctggaccatgtccgtgatggtgcaatgagaaaacagacgtgtctgctgttgctatgccaccttagcaaacaaagagctgcttcagtggagctccaatcaggtttcagagtatgaaattaatataaccattctcatactgttcaagttggattctgtttccaagcttccaattgttcacagttataaatatatttctttcttccctcattttattcttgagcctgaagtcacacacacacatacatctttctctggggatccagcattactttgcttaggagcaattaaattatccaatgaaaatttagatcttctgagaaaacgctggtgtcacaatagcttttaaaaatgacaagtgtagatctcctctaaaaattacatcttcaattattagtggggaaatcaaactttttatgttgaatgtaaaaggactttaatttttacagttgtgtaagaggaaaatactacattttctgtcaatgtgctactgctatcactgcagaatatatttggtaatatcattcccttgctttaacataactggatttgactttaaagaatatatcattaccactgtggaagctgcgtggtaaaagcaactcagagggtcaataagtgttctaacggtccacagagaagactctttgtagacaagtggcaatcagaaactacaactgagtcggggcactaagaatcaaggactgaaaaataataatcaatcaacattcttttaaactcatgcatgacaacttacattacggttctcaaacaaaaatgtaaggtaacgttcattttcttatactatattatctaggtattttatttattattttctaaaggaatatacctccatgattttaatataaatatagataatgatgtaaagagaaacatatactatataaaataaatgagtatcaaatgagcatttcaagtggtgacaccagtttaattgttcgggttttctggaagtctatatctgataactatatatcctgtcaaaactagtattgagaggaagatagaaagtaacataaattaatttaaatatgtaatatttttcctttcttttcattcccttttgtctgattactggtatcgttatttttacaataagttgtgacactgtgctgcttgacccacagaaaaggatgagaaaacttctaaactttcctttactggaaaattctataaatgttgtcatcaatctatattctgcagatagttaaaaccttttttttcctttaaatcaaagtgcacagaatttaacatgatatttgtgcaagagccaaagagataagaggtaaaaagtctattaaagagggatcaaaattcagtatttatgttagtacagggtacgtgagaaaaggggagggatgcacacacgaataatttcctattcgggaaacatgctaggcaaaacatagccggcttcctgtcaaatgaacaggggcacttatggttaaagcaccacatgtatttaatatgctatatttagtttttatcagtgaatgcaaatgaaagaaatattctgagatacttttatttctattttgggatatgatacttgacttttttctaggatgtggttgccaagaactgctttattttagtgaaaatgtcccacttgcacacctgtgcacacaaacttatctgtacaagtgcacatgttcccccccccacacacacacacctacacacattcacacacagatacacagcatacacacaccatcatctcttccagatgaaggccattctgtctgggtgagccattctttattgttaggtatgggaaacatgagttaaatgaatatgtgcctcaaccacacttttggtcatgtttaatatgcagttaaagcttttttgttaatgtaaagactaactaaatgatttttttcctatggaaaatcttttgcagttatttataatattaatttattgaaaaataataggataatttctaagcaaaaggcaagaagacgttcttttcaaagagtcaaatataagtataggttcaaccacaaatgtcttttttttttttctttgagatggagtttcgctcttgttgcccaggctggagtgccatggcgcgatctcggctcactgaaacctctgccttctgggttcaagtgattctcccgcctcagcctccccagtagctgggattacaggtacggccaccacacttggctaatttctgttttttgtttgtttgtttttttttttagtagagatggggttttaccgtgttggccaggctggtctcgaactcctgatctcaggtgatccgtctgtctcaacctctcaaactgctgggattacaggtgtgagacaccgctcctggcccatagatgtcttttaaaaatacaaaaactctggcacttttgtgtgatataattattttatgttaatagaagcaaggtgtttttcttttttaaaaaatcatgaatcaatcaaatcagataattgtatgatgcactgaattactcttatgaggcatgggcaagatattcctatttctcaggtgttaaatttattgtttgaaggttaataaacatttcctttaaaggtacttaactaggattggtacattgtaagatcactttcacacctttataaactccatggtgaatgtattatggtgtcctataaatcactcctattttagcaaccataaagaacattaaaaaaaacatatagttttttgtttgtttgtttttactgatcactatacagacattcattctgtcatggtctttttattttcaaagagaaaattgactttgtaaaagagcaaacctcttaatatactatctacatgtataacaaattcaatttcagagaaaaaacaatgtaatatgtaagagaagtaccgtgttttgatagttgactaacactgacctgtaatggtcctacaccctctccacttacttacactatcttaggtaaataagacttttattcctaagtgtgaattttcacaggaggagaaatctggcagatagatcctcaccatcatctgaacactcgaactggacttccttttctgaattgaccagtcaaagagaaaggaaaagaaaaaaaaatatgaccggttgaatttagagtatcaaagcatggagtatagaataattttgtttttaaagaggagctataagttgaatggaaggaaaaagttctggaaatgcgttctatgtaaggatagtaatgaaaataaatatctcaataggaactgtgagctctccatcactgaacggtacaggaaagcccaggagaagaaaatgtttggaaaatgtaagataccacatttctactattgtaacattgggaaaaaggcagtcatcaactatcattcttaaaatctaaatggaataaactaatcagaatgaagacacaattgcaggctgaggaaagcaattggtaaatggaaatggcatcctaaaggaaatcacaaatgcacagtcatcagtgctccagaaatttccaagttgcacacagacaggtggtaaagaaatgactgagcatgaacatttaaagtgacaaatgattttctatgttttcaatatgaactgaccacctgactttgggtcaaattcaaatgttagaaaattaattaattcccaagaacgttgaagtgttgatgaagaatgtatgcatctgtccttggaagagaaagaaaaggattaaagaaataaaacatttaggtggtactctgaaaagataacaaacatcattatgtaccataagattacattccaacaagagtaaatccccttgaaacaaaatacaatcagtaggaaagaaactgtattattttgtttagaaagccagaaagtaaaaatatcctgctgttatttttcttgcaagatttttctaatatttgttcagatcattcatcttgaatatatctcaacaccttatgacagaaacaaggaataattaagacctttataaaaactgcccaagcagattaatttagacatttgacattctattttccatacccaaatgtgagtatttttcaggctatatatttcagtggccttcacgtatgcagcataattatttggaaaagcatttggtttttacagacttttaggtcaccatggtagtttggaactgtagtaaatcagagagattaagacatttaattatttctataggaactctatattgtataacaacattattttttcatgactatttcatatataatccaacaggagaaatacagcttttcttgatataaatgttagtcatctttgtatattaaatcatttcatatttcaacctgcaacctttatcagaaacaataaaaaatagaacttgcaaagacttaggaattatatataacatttaaagattatccagcatctgaaagtcagaaatggattaggggcatctgtttaacttacctttactccatctggtttcttcaacaaactcttggctgctgtaaaatgagagtaaaatcagtttagtgagttatccatagaaacccacagccagacaacaaagcagtcaggttattgtctccttctaccacctttgctgagttctggccaacatatggcaagttatcaaagtcacactgatgaacgcgagcttacaggacattgaaatacagtatcacttttcttggtttgccacagcaaatttagaactaaagagtagttcgttgcatacaattgaatactttgccagttgtgtttattggactttatttcactgttggttgtgaaaaggatactggaactttaactggactatccttttgtaatccagaaagttgaattcagtctttggacatcagctgactgacagattgtattacatgttcattcacaccacatatggtgaccatgtcagttctgccatttaagccctgctttccagaggttgaaaattcatttgtaaaatttgctctggctaaataacatcttcattacattcttgaagtcagacaatttggttttacaaaaaatattactatttaaataaaatggcatattattggcttagagcaaatttttaaaatgtttagcacatgatctctaaaaaatggcattatgtattcttttatacattaaaatcagaatacaaaggcttcataaacaaaagcctttacaatgaaaaagtaaaaatcataaaatttgagacaacataaaaccagaataaaatcttcaacgaaattagagaaatcttaaagcatatgggtcttatatgaaacttcattttttttggaagggagcttttaacattccttctgttactaaacttcttgagtatatgaaaaggtgaagtcaccctttcagaaaaatctactaaggaatgtgtagatacacagtgaagagataatataactgtcaatgacaattagtacaccaagtgtagaacattcacaaatatgcaggacatgatacacacttatgctttcatttaatattaattacatatacttatttaagtatatcagaatagaatttggcttcgaaagtggaaatacctagctagaatagaactgcatgaacatgtaatttcctgacattcattgatttgggccattatttcaatatcatattggtatatttttaaatttacttaaaagatacaaaaatgttaacttcattaatctttagcaacacagctattaatttattattaattgagattgtaagaaatagttgccttagccattatattgtttgcctggagctaaaaagcagtattaaatcaatcctgtggcagttaataggttagaaagcaaactcagaataattgaaattgcaatagcaagcaaagagaagatgatgattcagggtaagcagggatttggcctgggagatgcaaaaatgtcccttttggttactattcaccttacctcacaagaaatacattccacataaagggagaaaagaaaaaataaaaacaacaactttataaccatatacttatggataaattactttaaagagcatgtttggcaatgaaataggatgaataaaatactctaaaatgcagtatcaagtacaagatgttgtaactgggtctaatattcttcagttgattttgaagtgatggattaaaaaaattgctttttcatgctaagacaatcagaaacaatataaaattcacatattagtcatgagtttttagtttacatgatgatgaaaaggaaactgtgaggtaaacaaaaagcttctatatatgggtacatacattaataaaggcccaatttatgcccaagagtgtatttaacacttctttaacaaaatgtacagttttaaatgtgaagattttttaaagtttgggttagtttgccattaacaatttatgctatataaatcactctaccttttaatgattcactaattactgggccacagtgaaatttatttgaatatcatatatatgaattaatatttaatgatatggcattgaactcacccatataaatgtcaactatattaatcaatggtttatgaaacaggtaacttgacaaaggcagcaacaaggtattattacactaaatgaattggacaaaatacatacaactggccaacacagtccctcaattcgtagcattattcattgtactactgttgttgctattttttaacagcctttgaaaggcctcttatggtttcccattatttgtaatgaaatgcaaaggtggggagaaaggtgaccacttaatgcagttgtaaataataactagatattggttgaagagcatttaataatgatatgatggattattacctgataacactataacacccaggctaagtatgtagcagaaaacaaaataaagaattgaaaaaatagctggacagtttgatgctgcagatcactgttatgtaaactgtatccaaactaaactggtagtatttttggctgacaagtgttccaagtctaaagggccaaaggttaccaagtgcggcttaattgctgctccagtccttccccctacataagactgcttagcattgaacaagatttgacttttgggaacctggtcctttgagacaatctatcaaagaaggaggttgcaaaactcaagtaatttcttggagtaatatatactttatctccacttttagagagtgacgcttacaataaagaaatggcttggcttctttaagcctattatttaacaaacttatttttaccatggaatcattttgagggacatttattatgctctgatagtactgagtgcaaggtgctctgtaaattcttgagttagatacctttgacagttgtaatcacttttatagtacaccaagaaaatactatacttttgaatgaacttaggtctaagagaactgggttcctcaataatggtcttcccttttttttgttttttgagacggagtctcgctctgtcgccaggctggagtgcagtggcgtgatctctgctcactacaacctccacctccctggttcaagtgattctcctgcctcagcctcccaagtagctgggacaacaggcacgcgccaccacactcagctaatttttgtatttttagtagagacggggtttcaccatgttggccaggatgatcttgatctcttgaccttgtgatccacctgcctcggcctcccaaagtgctgggattacaggcgtgagccaccacgcccggccaataatggtcttcttttaaaaatcttgcatactaggattccctatgaaaatgagaccaaaaataacttattcaaagttattactttatgaaatatcagtaataaattctaggtttgaaacgctgagatcgtaaatgagggagtatttatttccacaactcgtgcgcaccccagcacttgacagatgaggctagtcctgcaccagcactgactggtggccactgctgccagaagcagtcttgtgaggggttcagtcacggaggctcggcagcagacagcacccaggtagactgctaatggcagccataggtgtagaaggaatctgtgccacacatttgccacccctgaacaatgaagtttttctaattattagatttttaaaattccagagacaaaaaaacagagactacttaaaaagaagaccaagggataagaagcagagttcccaatgcatgtacctgagaaattccttgtagccagcatagttgtcaagatggcaccctgtgaaaaaaattagaacacaaaagtcagtgttgcctatgcaaattctggacctaacaaatatagagtctttgataacaaatcttttcctggccctactttcagttaggggattttttattgtttgtttttgttttttggtttcctgagagtcaaaggcctttgtctctcatgatgctgggacggccctagtgtgcgggccagattctgattatcaaattgcacagctgttttccactgaaggaaggatccacagcatgtgttgccaggatgattccagcttttcaccatagttttgattctggtgtatattccatttcccaagagccccaaaaagaataatgagagtattgaggtctacataattgaaagcctttgctagaagttattttcctcacacagtatttcacttcttagtctgtcaaatctacctccccataaaaatgtaaaatttcttacctttagttttcttctagcattaaatttcttcaagcagtctacagtctcctgtctgtgcatcatggaagcaacagtagaacgttgctagaagaagaggagaaaaagtaacttaattgagaatatttaaaacacactaagtataataatgtccctgacttcatcaaatatttattaatggtgctgcacctgcaggatcaacttctaagtattcaattgccaaagttacctaaaaataaaattttagttttgccaagactacttgtgaccaagatgcaacactgacgtatagaaagtatagaaatgggccgggcgcggtgggtcacgcctgtaattccagcactttggaaggccaaggcgggtggatcacgaggtcaggagtttgagaccagcctggccaacatggcgaaaccgcatctctactaaaaatacaaaaattagccgggcgtggtggtgggcacctgtaatcccagctactcgggaggctgagacaggagaattgcttgaacctgggaggtggaggttgcagtgagccaagatcgtgccattgcactccagcctgggtgacaagagcaagactctgtctcaaaacaaaacaaaaccaaaccagaaagtatagaaatgaatattaataatttctcaaattatctttattttaatgtcttcaatcacattttgattgagctgcctttcatttacttagtgccacatttatcaccttagcatttgacacatttggaaatttactgaagtctccagatccccctcaaatttcacactattcttcttaatatttctaaaatatattcagactactatgaccattattttacgccactgaaactctactgtcagctgccaaacttcatacttgtttctaaagttgcctaatgataaataattgaactttgttaaatcttttcttctgggacacatttaattttggtgttattttcttaaccttgttcatgagtattgttaataattgatatggagaatactcattccttttgttactgcaagcaatatttatttaagaatctatgcaattcagactttgctactgaaaattgcattttttcaccatcataaaattaattttcttaaacacctcgagtcaaaaattcattcattctgagtttcatctttttttgcaaagctattttaaatccataaacaatatattaaaggagagcttatttttcattttagttcttgaagttttggagaagttttacttacacagatccatgggtgcttcagtgcctctgaggctgtgatgcgtttggcagggttgatagtaagcattttattgatgaggtctttggcttcaggagtcaccgtgtcccattctggtgatggaaacttcaaaaatataaatttataaaaagtttaaaaaatagacacactcgatcaaacagggaagagtcaactacatgaatcattccctcaagtagtgaatttcttcataaatttactttttatataagttaagttgtatctaaaataaataaaaccatttagatctattctccccctctatgtagacaactatatatattaaagagtatctgataagggaccaacatatgtactgagctgcatatcacatatggtaaatacattttaaaattcagaaaaaaagaacttaagaatcttctattcttctcaaagtatctctgctttgatctgaaaatgaaattttatacaatctttctcataattatttgcaaaacttaataaaagcaaacaggttgctacatgtaccaatgtcatcatgatattatgccaaggttcaaaatgaggtattatatactttcacaactcataagcagtaatagcagaggtaataaaacagcttcaattcctgtgccaaaactgacctattaatcagggctacttggagtgctgtagtgagaagaatctgagactacaggagcttcagcaagatttcattttaacccttcaagaagtttaatctgcccaattacaaatttcaccaaagtatatgaaagtaatcaaatcttataacttcccattactaatacttttttatattaagactatataagaaagctacttctcctttctttacattattttttgtagtgataattacttaacttacttttatatgattagcatatttagtagaaatactgtccttcaacgatgaagggaaatttacaccacattagttgcaaaatgatagaatatcaggttattttcccaattcatgaatttgtatggacaatcttgaaaaataaagccattgccactgtgtcatggaattaaattagtccatttttagtagttttaaaatggggaacttgtgactcactggcataataaagcatgagaaaaatgatattgactctaatatctgtaatttttgccagctaaacaattgccattttttaattcctgaagcttatctttggcagttgtaaaagcttgctaactattaggagctgttaaagaaacacacgaggctgtttcttaatgttgtacaggtcttctgatagcaaatgagcggtaggttcagcatgaagaaaggtgaacattttcctcagttctctaattttcatgaaagcattcctctaggtataccaagcagtgcattttcagggctacgtctgcccagagaggggctggttctagtctgtaaagatggtgaatgtgctagctattgccatgtaaataataatttgttccaattactagtctaggaataatgcaatgctttgaaattcaaagaatatacatttttaattcttgctgacacacacatccatctaaatagaaaatttttatcagaaatgcattgaagagttcacgagacattatagaatataataaagacattttatatcttctcctctcactttcacattgagctttcaacttgtgcacaaaaggtgaacccaatattgctactctgtagttactctacttaataacacatggaaagcatgcccagaccctgcacatggatttccatagggctgtatgaggggaaacctgagaaagtggtaaatcatatttacaagaatatgtatcaaaggagagcaaattatatcataaacacaaagttaagccataaagagaaagtagataaagccttcctcttcagattctgaacttaatttatgaatgtatatatatatatctactttcaaatattctaattataaattaaatatattattagaattatgattttcaaatttttcaattgtgaaactcattcttcaaatgaaagcttgcatagtatcccaaacagtacaaaaacaaaaaacaaaacccagaaactggtatagtgggataatgttctatttgatatgtgatcacagcaaaatattgttggtatataatataaaattatgtgatagatatttgagaatataattcaactaaacaggcaataatcatttctatagcagaaatattttaatttttatgtttttaaaatgcactaaggtccaaatattttgacaaagttcttcctcagagacttcacatggcttttctttcaatcttaggagacagtgagttaaaaggaaacgtaaactggatacaaatgctgcatttctttctccctttccttaagagagagggaaataatatgagaaagtggtaaaaattatggttaaaagaaaaatgaaaagatctggctcttggtcaacaggcaaaagacaaaccttcatctaaagtgatataaatagttattacatacatcataagctccagccttgatctgctgatagagtctgtgttggtcttcatcccagaagggtggataccccacaagtagaatatagagaatgacacctggaggagaatataatgttaacacaatttaagtcatatagacaacagtaaattaaatgtggctgatccacaatgatattaagccgtagttgttaaaacagagaaaactggattgtaggaaaacttcagaaagatgtgttatgatctagtctagagcagtctctggagggtgaatgcttctcctcctatgctccagaactctgacaatgtgtcagtcaatgcatgcatcaaagaattctaaagaggcatggcagggcaacattcatttagggcaacattctttggcccccctgaactcttgtctatagagggtcttactgcattcttatctatatagagactatgattttagtcactgtgaggttgaagtttaaaaactaagcatgttttttatttcctcatacttgttttgatggtcattgggacattttgttgagtgatggtgtcctggttataaatccacgttctaaataaccatagtccctgcaaatgtgggtaccccatagagacaaaacccttttcttttcagtaatcttagtcttcaaatacttcaagccttctcagtcaaacaactaaaccaacaagactacagaagaatatatattatgggagaggaaaaagggagagaagggagaaattccacagaaaattcaaagtaataataacaataaacacatggctgtaataaaatttgctaaaatttttcacaaacataattatttataaattaaccaaaatctaatttcacttttaaaattaaaaaaattctgtattcacagtttgtaaatttccctgaaatcatatctgcagtctaaatgtctgagattgttttgatacagtggtcttctctgtcatcaaatatctctcctgccacttttcacgtattttattgccttgcttaaggcctttggtttctttcctagctcattatcctggaggaaggcagtcattcctctgacctctcctgtttgcttttttcttgctatgtttccttaagcctaggaaacctgagaagaagagtaagacaggtgacactttgccaggtgtaccctgagacttattttttcccttatccaaggtggtctcttggtctctgtacctaggagatctatccctgctcctgtccagcagtctggacatctttatacaatagacactgtagcagctgaaatggtttttaagcaatggtttaatcatcttagaattttatagcctgcttcaggaagatacagttcataagcagattttttaagtcatgtgaatcaatacaaggataaaaaattttaaacaacattcttaaggaaaaaaaaaagaccatgaagaaaaccacagtatattggtacctcaccttcatgacataaaaataatttttccatacatctaatgaaaatgatgatagtaatgatgatgatgagtgtttctctttgtgttctcaggaggcaagtagaaaaaaagctgtacctgagtagttttagccctcagctatataaggttccaggaggttaagaagaaaatttgctttgtaatagtgatagtttccattgaatatgaacattttcctaatacacatctggaattaggctgttatagaattatgaaatagtggctcaactgagacatttagcattctcaacataggctgtttgtccttatgaattatgtctgcagttgacagttgatgtggtgcttctctgggaagaggaagctcacagagggctcattccatgagaaaagcaggcaatatgtaatagatgcccacaatttagctgtttgatggaggagtgtttacaaaaacatgtactttaaataaaataatagcataaatgtgaagattaaaaaaaacacttttaggcccaaagacttaaaaaaaaaacatattataggtgctattgactagcctgatgtgaaattgtcagtgcctatttaaataaacaccgttttgtaagtttacttcaacttgattattaaacaagcatctaaaacctttctgagttatgctattttgtagttctattttctgaatgtatagaacaagtatgagactcatggcataaggataatgtaatactaataaattttattgtagataacatttattcagagttatgtgtgctttaatgcattatctcatttaatccttgtataatgctatgaggtagatattgttattatctgcattatattatagatgaagaaacaggctgagagattaagtaactgtttcaaccacaagcaggacagacataatgatgctctaaacattccctgcagccactttttctttatctatgaactttagtaggaatgataatataaaatttaaaactttgtgttgtctaactgagagaccttgacatactagcaaagatgtccatttggtcctatcttaaatgttccttgcagctactttttcctttagctaggtcctctaaacaaatgcttattttaaaagtgtttgttgttctaggccgggcgtggtggctcacacctgtaatccaagcactttgggaggccaaaacgggcaaatcacctgaggtcaggtgatcacgaccagcctggccaacatggtgaaaccctgtctctactaaaaatacaaaaaaattaaccgggcatggtggcacatgcctttagtctcagctactcgggaggctgaggcaggagaatcgcttcaactcaggaggtggaggttgcagtgagccaaggtcgtgccactgaattctaccagcctaggtgacagagtcttgtgactctgcctcaaaaataaaaataaaataaaataaaataaaagtgtttgttgttctaattgagttcttgcctcatgagtaagcccaatttatctttttaataaacctaaattttaccttttttctatgtcagagaaaaaagaaaggaaaaaatcactagctctttttctttgcccatatacctaaagtactaaaatcattaaaagtcaatgaagaagtcttttttttgcgagaccacttgaggggtgatgatgtgacctccaaatgttgggtatctctcatgacactagcagccttttatgattactgcctacataattttactggggttgcaaaataatgatggctgggcatggtggctcacacctataatcccagcactttgggaggctgatgtaggaggatcacttgagcccaggagttcaagattagcctagccaacatagcaagaccctgtctcttccaaaaatagaaaaatttagccaggtgtggtggaatgcacagctagtcccagccacttgggaggctgaggtgggaagatcacttgagcccaggagttcgaggccacagtgaaccatgatcacatcactgcattccagcctgggcaacagagtgagactcacaaacaaacaaacaaaatgatgatactctaattatatcatgctttctttagactaagaaaatcttgctccttatccacttggttggcctaagatacagttcatataggaaagataggctattatttatttattttcctctttactagccagtttttaaaataacgcattggctccccaacatcccccaaaggttaggacttctgttgaattttgattatcattatcaattcctggatttaaacttacttgatgtatttcaatctattatgttatttttcttattgattctcaattgccccatctttggctagtgccagcctcctcaaagtggttcctgcatctgttaatataaactctgtggtccttaatagtttttctttgtggtatgacaagatgctcctggatcatcttgcttttttcctgttctaaacttgaaatcagctgctattacagaaagttctggttccttttaatggtaaatagtatctagagaccaagattgagcacttacatgtgctgtcttggagctacagttttctttgaaaaataaatcaagaaataaggagacagaagagagaatggagcaaaaattacaaattaagaatgactaagagacctaagagaccaaacaagattatgacaggagaggataaataggaaaatgactagatattttgatgttactaagcaataattattaaaattttaaaactaatattactgtcatatttagagtccttttcttttagagatatactttaaaatatttatagatgtattgatacaatgtttcaatttggttaagataatattggagtgggaaatgaaagggaggaaatagatgaaataagattagccatcagtttattatagtattctctccattttatgtttcacatgttccatgacaaacagttaaaactatttttgatagagttggttccatatacaggtagatattaaaactagttttccttatcttatgtatatatttgtgcttgggagatgctagagatgtccggttaataagacttttgagaagcactgattacaattaggtagaaagactatatcatcgagaacattcaaaattgattttaataaaagttaatgttaaaaaagttgttaaacctataatcttgttaataattaaacattctaaatgctgttcttacaaaaggagagatgaagaaggaatgttggagaactctgagaagatagtaggaagttaatggaagaatctaagacagttactgaatattctaagtaaataaaggggtacattataaacttataagcaaaatgcatgtggaacttggaagtacacaattaattacatgagtgataagtatggctctctcttaccttgttgtagtatgattaatggaaaatcatcatacatttcaagtagagaaagtgctcaactaacactctgacctaaatggccaatgaagggcagaacaaagagctagaagatcaatgccagcaagataggaaggcatgtttcagaggatggaaactatctatgccatgtagtaggagtggcaaactgacaggccttttggcagcaggcagggatgaaggcctgcacctgtactgtgtatggggtggggtggtcaccagggcggcagctgtgttcatgtgtctgacaggtacaattactataaaagagcaaaagcattgcatcacctgttcttttgattattttagagaagcaagaaactgatagtttttatagaaattacttgctaataaattataaagataaataattaacatcaacactcataagaataaaatgtccgcatgtctgactaagacagcagactgcctgcaatggagagaatgtttgtacggctctcaaaattcatatgttgacatccaaatcccaatgtgatggtatttggtgtggtggggcctttgggagatatttagtccatgaggatgggtccctcatgaacaggaacagcacccttttaagaagacggcagctagctagctagctctcttaactaccatgtgaggatacaacaaaaagttggcagtctgtaaccctgaagagggccctcaccaaaacctgacctgactatggtggcaccctgatcacagacttccagcttccagaactatgagaaagaaatttcgttgtttataagccacgcagtctatgtgactttgttatagcagcctgaactaagacttcacctgtttgcaacctctgacatatcctgtaataatcctaaaaactgctctcctaaaggaatctgaaattagctgtggtagtattgcttagctttggtgttgcatcaacatcacctggtgcgcttgttaaagtgcaaattcctgagcctcacctcagtgaatctttttttttttaaattatgctaaaaatacctaacattaaatttaaacacatgacattaaattgtacataaaaaaggtcccgcacagtgactttaaattgtacataaaaaaaggtcccacacactttcaatcccagcactttgggaggccgaagtgggcagactgcttgagctcaggagtttgagaccagcctgggcaacatggcaaaaccctgtctctacaaaaagtaaaaaattagcagggtgtggtggtgtgcacctgtagtccccactacaggggaggctaaggcagaaggataacttctgcctgggaggtggaggttgcagtgagctaagatggtgccactgcaccccagcttgggcaacagagccagaccctgtctcgaaataaataaataaataaataaataaacaaacaaacaaataaataaataattagtacataaaacagatctttttttttgttgtttttttgttttgttttgttttttaaagacagggtctcactctttttcacccaggctgaagtgcagtggcatgaacatggctcactgcagcctcaacttccctgactcaaatgatcttcccgggctcagcctctcgagcagagtagctaggactacgggtgtgtgctaccatgcccggctaattttttctgtttttgtagaggtagggtcacactatatgttacctaagctggtctcaaacttctgggctcaagtgattctcccaccttggcctcccacagtgctgggattacaggcatcagccaccatgtccagccagatgcacaatttttaagtgaacagttttgtagtactaagtacatttacactgtcatgaaacagatctccagtttgttttcatttttcaacactgaaactctatatacatgaaacactaatttcccctttctctctagttcttggtaatcacctttctattttctgtttctatgaaagtgactgttttaatacttcatgtgagtagaatcataataatatttgtgcttttgtaactggcttattttgcttagcataatgtccttggggttcatccatgttgtagcacgggacagaatttccttcttttttaaggttgtataatatacaattatacgtataaaccacattttgtttaagctatttatctgtcaatggacatttgggttacttccacctcctggttgttgtgaatagtgttactatgatcataggtgtacacatatttcttcaaggtgcttctttcaattcttttggatatataaccagaagtgggattgctgcatcctgtggccccagagaatctgattcaatggtcctgaggtagatctcaggagggtgcactttaggtcactctgaatgaaccatgtggtttgtgtttcagagtttgaaaaacaccaagttagggaaaccagacatagtaaatgtagagaaatttaagacagtgtgtaagttcagagtaagagaatattggtaaagactatgattgggagtaaggctccatgaactgaagactgttggagatgtgggtaagaatggatgaaggcagaaggcttctaatctggaggcctatctgtgattggccaagtgtaaggtaacctcagaactggtaatagcaacagaatatccagtaggcttgggatttcaaaatgactaaagtaactgataatgacttacaccagctgaaatatgaaaaggttaaaccccagaaaacacatcattgctgaacctaaattcaccacacaagaaaagaagaaacatattccataaaattcccaaggtttgtccgaagtcaaggtacatttgtgacagccactaatttattatcactcataactgttgagagtgatacctaagtaaggcagaaaagtagcaagacaacacatatgtacatagggtgcgggagagacctatgttataggcttgcatttatttatttatttttaggccaaattgtagaagaagctctgttagaaatttgtgatccagtgacatccacaaacatttcctcatcccattaggaaattatggaagcagttatacatacaattaagtcataaaaatcaatttactgctgttaatggcagaacacaaggctatgttcttgcttcattaatgtttattatttgctttccagtaatggaatagttgcttccaaagagagagtacaggtcagaccatactctgtgtgcgatcacaaaagcaaggtaatgttggaattcgagatttcctgtgtgcagataattgcatgattctaataaaaataatgtacaggcttgttttagtcattataccaatgccctgcttcactctgctctgctgtaatgagggttcagagcttaattcatatagaaggctagctgcctttctgctaaatggcttgttttgcatttcttttgttttctgagtagtgtaattttttaccactcaacccagtgtctactcttgaaaataagtcactacttaattggcaagagacagtgctaatgaatggctaaaaaagagtttccctcaggataagccacaacctaaaagcaaccaaatagtgtgtccattactgtggtggtgattacaatgatgatgagtttaagggtacatcaccttacaaataaagtgaattaatgtcactttcatgtcacacgagtgaggtgatatataataaaatggtaaaacaattccaaatcccacaacaatgaccaagatatgtaacaaaagaatacattataatgttctagtgggagtcatttcccctcaacatgtgatattagaacacttaagacattttcatagctgtgtgatctcaagtgcatttctagacaaagcgtccacacagtctctaaagaaatggaaattggtggcacatacatgctccaactggggcaaggctcatcacaaaggaatttggctgtttgcataatattatgtgaagaaaggatacaatatagcaaggtgaaaggtggcaaaattggggttaaaaatctatgagatgccctatggctataagtttctaaggagtcattcttgatgtgtgtgtgtgtgtgtgtgtgtgtgtgtgcatgcatgtatgcacatgtgtacgtagtatctatctaatatttgcttaacacctaacaaaatgttatatagtttagaaaacaaagatggaaactactctctacctatcctttttccctcttccagacaagaaagttagagcttctaacttataagttctctcacatttcacagatatgaaatctcactattataagatattccattattttaaaaggttagatatatgaactgtattacagaaatgtactcagacaatccacataaaatcaaatattccaaagtaatattaaaattgaacatagtgtgttttgtgagtctaagacagtgaatccaaactctgataatacatcataggttattaaaaatgcagttgcctgtgtttaccacagatccactaaagcagaggcccatgcaggatctgggcattttgatagaaaggcatatgtggttttactgtgcttttttttttttttttttactgtactttgcagatattgcattttttacacactgaaggtttatgataaccctgcattgagaaagtctgtggtgccattttcctaacaacttgggttcactttgtgtctctgtgtcacattttggtgagtactgcaatatttcatgaaaggaagagttaactgatgtggcaaacttcattgttgtcttattttcagaaattatcacagcttccccaacctttagcaacaactatcctgataagtcaacagccatcaacactgaggcaagactcttcagcaaaaatattgcaacttgctgaagactcagatgatgatgatgatattttagcaatacagtttttttttttcttttttctttttgtagagatgggtcatcctatgttgcccaggctggtctcaaactcttggactcaagatcctcctgggttggcctcccataatgcaaagattacaggcatgagtcactgggcctggctattttaaagtattttttaggtaaggtatgtgcatttagacataatgctatcgtatacttaatagactatagtacactgtaaacataacttctatatgtactgggaaaccaaacaatttgtgtgactcactttattttgatatttgttctattgtgagaccagaaattaaacccataatatctctgaggtttgcctgtatatgcttcatcattgatttttctgcacagccagagaagaatccctagcataaactattagctttttgggtttctttttagtggatctgatattcttcaacaccaataaaacttatacattataaaaaaaggttttaaattttcaaaaaattcttaatttttttggattgacaaattatgattgaatacatttatggggtataatatgatgttttgatatttacagatatacaatgtggcataattaaatagagctaactcacctatctatcacctcacttgtctatcattttttatggtgacacatttgaaacatgaaaaaatgttttcgatataagaacaaatgaataatttatttaaattctttggcagagtaaaatatgattcagaagctgtgaaatctgtccataataacaccttttacaaaataaaacaagggaaaataatttaaaagtaaagaaagaaagcagagagagggagagagagaatttggtattcaggtcatcagatgagggcattctactgataatcacgccaataatgctgagttatataatacactttgttttttaagcctactataatgcatatatcagttatctagaaacttcatttataaataaagactttgtataataatagcaatgataactatcacttactgtatttaaaaaatcctctctgcagtcccatgaggcaagaactttgatgatctccatttctaagagggaactgagacacagggactaaagaatttgtgccatgtcatacagcaagtgaactgagaagctaagtgtgttctcttaaccactatacatactgcctcttacctatgaagtagacaggagggatgaagaaaaaaagtagaaaataggaaggaaactaggaaaacaaggagagataaacacaaaggcagaagaggctggaaaaggcctttgatgaagcaggcaaagaaagagtatgaaatgtcccttatgctgagtcctgcttcccttggttactgactattgtatgccacactatccctctagtgttcaaggtccaaatgcagcgttttagctacaaccccctatctttacaaaaatatagctttatcatgttttaaaaatactttaaaaaatatgattgtatccttcacaaaacctgtctgtgtctgcctgagtctcaggccactctgttgctttttaaattcatcagcagaaacagatctatgtatgctgggagctgatttattgcaaggaaaatatctgagatatcttccattaacatttagatttgaacaaagatattttgtgacaatgctctaattcaaggcattttagagttcatgccttagagttcatgcttagaagatactctcaggtaggtagcaggaagacagagcttggggcattcctaagaccttacccattaattaagtagcaattgtcaattgtcttcctttaaagtgcactgcatttgaccctcctacaattcaatgagggtaacatattcctattttacaggtaaagaaaccaactcagatatattaaagagactgggttagtaggtaaaacgtaaagactgaaccccaggggttgaaactataaatatagtgccctattttaccactgccttcccaggcatggaggtaactctgaaagcccaagattcaatcagtttaagatcaaacatcaagttgttaccaaagaggtaaagctgacaagaaatatagtgaggaacagcctatcactataaagtagtgatgatgaatttattaactttttaaactaaaacaagtctaaaaaattattttcagaatcaagtaaagttttttaaatcaacttttccaagcttgctgacaaacaccaaaggcactgaaatctgtctgcagcacactaaagccaaactatgatagttaggtatctacttgtaggctggtagcaatgacatagtatcaggaatttaggtgattatgttgataatcttagtagggtaatgttgcagcattctttcagtctttcctgtattcaaaatatatgttgaaacataaaaattccattataaaaactgtgggtgaaaatcctccccattatatgtctttgggcctgcataggatactgtttttgatttgagttggctgatagaggcctaaatcagacttctgtcccctcgggatggtcaatttcattattttccaatatttactagttcactcttaaactctgccaagtatcatgggcaaacataatacttattggaaggactggctggatccattgagaagatagcagcataaatacataaccactaggagcaatgctccacatccctgttatcaaagtgttccagaaaatggcagcattagcatcacctgagagtttgttaaaaaggtaaaagtttctatcctggatatactgaatcagaaacacagcaatctgtcatttaaacagctgtccatgtaatcttgctgtagactgaggtttgagaacttctactgtaagtcgatcactagagaatatcaacttcaaatttaaaagatattacagggtgagtatcccttatccaaaatgctaaggaccagaaatgtttcagattttggattttttcagattttgtagtatttatacatacataataagatatcttggggatgagacccatgtctaaacatgaaattcatttatgttttatacacatctaaacacatagcctgaaggtaattttatgaaatattttaaatattttttagcataagataaagtttggactgtgtctgactgcaacccatcacatgaggtcaggtgcagaattttccacatgtggcaatcaacgttggcactcaaaacgttttggattttggaagcattttaaatttcagattttttgattagggatgttcaacttgtattttaaattataaaaattgtggttgttatagacaatatttgtgtccctcataaaatgcatgtgttaaaatcctaactcctaatatgatggaaggaaggaaagtgaggtctttggtaggatggaggcctcatgaatgggattaatgctcttataaaagagaccctgggagccccctctctgtttctgccatgtgaagacacaaagagaggataactctctataaaactaaaagcaggccctcaccagacaccgaatctcctggcaccttgattttgaatttcccagccttcacaactgtgagaaataaatttttgtggccaggcatgctggctcacacctgtaatcccagcactttgagaggctgaggcaggtggatcacctgaggcaggagttcaagaccagcctggccatcatggtgaaaccctgtctctactaaaaatacagaaattagccatgcatggttgcacgtgcctgtaatcccagcaactcaggaggctgaggcaggagaattgcttaaacctgggaggcagaggttgcagtgagccgggattgtaccactgcactccagcctgggcgacagagcaagacactgtatcaaaataaataaataaataagaaatacatttttgttatttaacccacttggtctatgacagattgttatagcagaccaaatggactaagacactagcttatcacaaaatttgcttcaaaatataattgcttaccacatgcccacatatccactggctttccataaggatctttacgtaaaacttctggagaaagatatccaggtgtgccagcaaaacctagggaaaagagatgttaatgagtcacagttgatttgacaaaacaatatgaaatgggaaactaagaaagaaaaatatcgggggcttctttatctgattatatgtttttcaaaacacaacaaggttctcagagcaataaatagtgtagactttctctttatagaaatatcaacactagtatgccctgccctgtaactcatttgaaaaaaaatacatctttttttccagatatgaaggccaatctactatgctgcaaagtcactgtgtatacttaaggccacttttggttagcaattcttattgtcctttatgtatatgggagttaaaactacacctgaaaagaaatatggagaagaactcaccaggagaagatataagtcgaaaatatatcacagagctcactgtgtactgttaaataatcagtatgtacttgtaactggcaactaaagagaagatgcaggaatattcagatgaatcactactgaacaagtatcaactagacattcgacttaagaagggatgtggtaagaaaaactagatggggaaagaaaacttcatattatacatattggtatagaattcaataagttacacttagaaacaatttatagctagaatctagagtaaaatatttatttctgaaaataacagttttttaaataaaaatgtttacttgaaacatactaaaaataactatcctcatttggaagttttctttaaaagcacaaataaactaaaaaaaactttttaaaagtatatataatggaatttctccaaccacagatcactgatgaaacacactgtatacttattgaaatgcaaagtgtccaagaaagaaactttttccccatttctgtgacaaatttatacttattaagtacaaacaacatgcaaagaggtattaaaagacaatatatacaacacagttacttctctgaacaaaaaagaaaatgaggaaaaaaactttgcacttaatcttttttcttttctattaccattcttctttttctgtttgttttgggggaagattggatagacaatgagaagggattccaagaaaagacctgtatgttgcaatttaagcttcaaatggaccctgggtaatccatctgtacctcaaactcgacttgaaataaatatttggttggtagttgtgaggtacagagaattactgagcaataatggtggttccactgcctaaagcttgaagatttcctcaaggagtgatatgcactctgtgaattccaaggtagagatggacacaattgttttaaagagtttgccagcacttctgtcccctccactctcaccatccttctccaacttctctagagttgacaggcaatgagactccagtgagaaatcgatgctaatgtccagattacatccaatgttcttagtgtgcactttcagatcctttatcatccggctacacttcattcattcaacatgatttcattctccttctgagcccttgacctgactaatctctttaaggtcttttaaaaatggccttctcagtgtcacccttgatactactttttctgttccttgaatcctcaatattttttctctacctcttttctaacagagagtggctctaagttatttccatcttagagctctccttagttacctacagttctcggtggtcccttctcaccctgaatttcaatgactcttttatatacaatctgtactcttctgtctaaatcagtaaactttaataatgtatgatttcaataacttagaatacatggccagaagtacgaaatgttaacaatacctctcctaagcttccctaagatagggaagtaagttactatgtgaggaagaaatgaaaagatcatttaaaatataaattattacaaacctcttctggagactaaaattctaagagaataccagcatgctcattcttatttagttacaaccatcatttgagcagtcaatggggtccttaccccaagaatattgaagcatatatctaaatgcatggacgttaggaaagaatgtacggtacaatgtgacctcataaatacagacatatggggggtaaaatagagaagaccttctctgtgggaaattaaacttgcaagaatctaggattatcatactacatgccatcaatagaaaaagtaatgagagcttgccttttttagggatagcatatgtttcttactttgaaaaaccaataagaaaatcaaaatagataacacaaagagaaaagagaattactgactgttggaaatgtatccattgtaacacattggcataaaaagaaccttaatatcataaaaaagagacataacagcaacaaagcaaaataattcttccatgaaccaagatcttggtagttatcttttttttttctagcagcaacaaaatgctagaaatgtattgcaaataacatgtccagttccataagagaaacagaatatatttgaatatttctttttggtaaattttctagccatcttatcaagtatagtgacagggtgtttacttctaccagttttggctagtattccaacagaccagactagaaaatgaaaagtaaatatgggaaaaaacaaacaagttgggacttgaaaaatgataattaaaaaaaaaacaataaacagcttccataatgctttgtattatctattatgttgtttcgtatacatactatgttttttcttatttgtaatggacctcgtatatttattaaaataaaattatgtaaaagcctgaagctctggtattccacataatgaagaaagagtcctgctctttatcaaaattaaaataacaaagcttttcctccataaacactgatattacattttgaaagataaaattaatcagtaaaaatatatgggactataatggcagatcataatgaataaacatcaaaacaggtcattcattattaaaacatgcctttactcctaatacttaaaatatatctggcagctcatctgaaagaaacgtagaacaccacatctccttttttctcagattaccatgaagattcgcttgaacttgagaaaagaaaaagaaagagaaaaaagaagtatattctcccaagtttagacactctgtttttctgtacttctgaaatactgaattgccttagaacttaagatgttgcttcttttaaaagttattactctaacaggtaccttaacaataacttaattgctgatagcaccatgctgatgaagtggaaattttattgctgagctgtcactgcttctttgggaccagcttgtttttagaaatcagtaacaatttgaaaatctatgtacttttatttggatgctattgcttttactgacctgatattcagtcctctactcactgattcactaaacaactctcactgaatatgcaaagaattatgtcattgtttcacaccaagacaattttgaaaacttattgaacatcctttatagctcaatcaagtttctatggactatttcactcaatcttataacagtcctgtgaagaagtgtttattatcccatttacaaagaggatagtgacctcacagatttaaagtgacttgctcaatatcatacagctgttaagaatcagagccaagatataaattcatatattctgattcataaagtaaaattttttccactacacatagccctgctctcaaactatatgtgtcatagcagaggagataaaacattaagctcaaaaacagacgagatttaaggagcttgattccaacattcttgtaatcatcaaacatagctgctgatgctaatttgagcctcagacctgataacaaaggcttgtcttattcctgatatcctatcatcatctttaccaatttctggcaattatatccctgggcctaagttcccatttttgtatcctgcctcataccccaagtctctcatgaagtggggtcctgctttgctctacacaggactcgagtcctgtctttgaacccaatgtctgggactttcatgtttcctaaacagattcccttagagttcatatttcctgtctgatctgtatgttatttggaacttgcttgctcctacaccctccctagtcaacgctatcatcatgcataatttgaacgattgttttagtctaactgggtccttgcttgcagattaactatgcttaaatcatcttctatacttctactggaatcattattaaacaacatacacccagttatgtccctctcttctaaaaatgtttcaccagatcccaaaatctctaaggtgaaatccaaatccttcaaaaaaacataaaatcatttcctgcctcattaactactactcactcgagtatactttagctttatcaaacttcttgttttactgtaatagaaaaaatagtttcatgcctctgagcctttccatgtgcagatccctctgtctggaatgccttaatcttcttgcatgacagtgagcaaagtcccattcatcctttaggcaaccataagtgttaaggcaattattgaacctctctccagaggcaggtttttgtacttcctgtcttgtgttcccacagcacctcatacattcctatgttaagatacttccaccctgaatggtaaatagttatagatacaaaagccttagctcctccagggtcaggacttcctacttaatttatgtatctctagtatttgctttgcccatctctgtgatagccccactacttcctgttcaacccttaactcctgttacaatatattctttctgtgttaattgtactcttttccaggatacagagatcatctgaatctctaatttacagacctaatctaggccctaccttcgttcagtttgcagttaatgggtacaagcttattaaaaagttaaaatattataaacagaatgacaagtttggaggtattaaattcatctaggattggagggtaaaaagataatgtaaaagataatattaaacatgagagagacttcaaccaagaataactgtcaggtactactgaaaaaggacaggcagcaggaactgaggtcctgcattaggctgccagggaggcttggcacaccctccactcccagtaacagctggggcagaaaagggagatgtggtgaatcctgggagccatatgtacatcttgggagatgtgtacattagggactcagaaaagtatttgcatataaaacaaagaaatagcatgtttttagtcctctatttgttgttgttgctcagaggaaaataaatcagaaatgaagggcattaaaacaattatctaacctcaacacaccgaaagtcagaagacaagacaggcttggggagaggttatatttttggaactatacatgggaagtgggttggatattggaaaatggcagagagaggcatatgaaaattaatgagtaaataatttattcagactgaatattgaaacaaaacataagtctggttagaaatactataatttaaatttatttagagttaatttcttccttaattgtaaagaagcagaaatttcatcatataaaaatttctaaattatcagaatttttgagaggaaactggcatgttgaagacatacaaaataactaaggtgaaatatacacataaatagatgcttcataatttttaaacaatctttaaatcataaatcataaagtattatatgtgaaatatcctgtgtttcttgagcatctactatttacacagcagtttttggcatcatatgaggttgtatgcaaacaatcaactttctttcaaataaaaaaagtactctttgaatgttgtaatcctctaattaatgcttactaaataatgtactttctcaatcatcctttgaagaaaaaagtgtatgtcttcttgttctcccattaatattttcccttgaattatttctagattatataaccttttatgtcaacaaaattaaatgcttataaaggcacaatatctaaaaattagtcaaattgttattaggatgaagttttccattttattttcactaggaagtgggattaggagccagaattcagaagccagaagactataggtagcatgaaggagggggccctactcaccaaaccacgcctgctggtccccttgaacttctatggctaagccaaagtctgccaatttcacagctgctcccttggatttgctagctaaaagcaaattctcaggctttatttagaaagaaaaaaaaagagactgaagtgagaacctattttaagcgactattcaaaactaacaacattttacaggattagggggaaaaaattcatgcactgtcatctttcctggagactgccattcctaaatcccagggaaaatacagttagaaaatgattaaatattatcatgtgtgcaggcttcagacagatgcataactgtcctagagagatactgggtagaagagagaatacacttggggagggatcaaatgaatgagagcacctgtcttgacctgctcacatgtttccaaggactgctcaggattcagacttggccacggacattgacttagaagcctaacagagcagacattttcagcagaaggaaacttggcaaaataataacaagagttggaccaatctacagacatttggcaaatgaaactgtgcaaattaaatcctagttaacttcaagagtttggacccaaatgtagtgattttgattcctcaatgtttccaaacaattttggtacaaattttggagacttactctgaattatgtattaaaattgctgtctttaagaatctgtttattcttaaaggcagaaagagtatactactatttgccaaatgttatagtcagcttttttttttctttataagccagcttttaaaacataatttacatttcttcaaagcgtgattcagagcattacttatatatttatttttccatctcagagtactatgagaaagatatatttttattttcttgggtacttatcattatgcaagggctgataactcagtcttggaataaggctgtgtctataccactgtttcccaaccaatgcatcaagacacatcagtactttgaaaataagcaccagggaacagtcttcaatttccatgaatcgcctttgtggattttaagaaatgaagatgatcaggaaaaggagactgattaatatatacagttaaggatatacaaccccaaactcgataaatatattgggttagaatgtatatgggagagtggtttggggacaaaacccagcaaatttagaggtgtgtctcagactgaaaaaagttgggaaacaatggactctacaaatgccaaaacgattgtctgaaaatctaaaaattcagtcaatcaaattcattttgtttatatgttaataaacaagtaatgtcatgctttaaaaatcaaattggctaaatttttcccactgaatttgtcaattctgttggtagttttgaccttgtgtaaacacagcctaaaccagtatctaatttattaattaagccagccatgcaaattagcaaagacccataaccagaacttggaagaaattaggttaaatctacaagaaattagagtgttggcgagtaagttttaatcaagtaccagacttcttcaggctattgttgctcactgccatcagattcatcgctattatgacgaccggtaaatgtgagaaaacttttctaattttgtggggctgatagggatttttaaccacctcaacactaaatacgtaatttaatttggagtatgggataaagatatctcaagaatataaaagacttttatgctgaaatgacttttagtaaaacctaacacttgaaattatttggaactttatcaatatactatagtatctacacatgttaaattattttaatttgacattttatttttgcaatgaaaatttatggtctaccacattcatgcatttcctaatctgatcaagaagttaagttccaactattaactcatggaataattaacttggaaaaagctcatcaaactgtaagcaatggttgattctaattctttcttcactttcaaaagcactggcatgtcagagatttctgttaatacacatctgtcctaatttgttaaccacagactcattcaaaaaaagagttccaatcactttagaaatcacattttaggtgtttgaagtcaggtgataagtttgttgagcaactgtcagcgtaactggtaaataaccttttaaaaaattgagtgtgttttcactcttatcactaaatgaaaaagctgttgggcagggcttgtgtgcattgtgcctcaagcaccaagtatctgccgattcagaagaaatggaacatcttagagttttatcatgcatatcctctgaatgactggggcaaatactcataactaacgaagacctcactgtagggcctttgtgagtcatccagaaaatagtaaatccatctggaccagagttgcaccttatactcatgaagactgttcagctgcagttatgtagaagaaaaggcagggttatttgaaggtgactgtgtagatgtaacaattaagagactaacatgatttcatgtttatgtatatctttaggcaaacctaaaatacagaattatataacgaaaatgtaaaaattaggatgattactaaaatttaggctctaaaatgaaattatataatgaaaactaaaaaatttaggatgatgagtttaagggattattcactttttaatatttcatcacaagattgctttaaagggcagctccaatgaaacattaaaaataatcacacaagtttgatttctatataactgtttggtatatattagtttgaataatcctcctatcatgttctgtgattgtgtgggaggcttaatcactaagactttctaaagcaacattttaatcagggcaagcacatttattctaattttcctgaattactaccactcatatagcttccaagttaaaaatatattgtactacaaaattttgttgacaaggttaaattctgaatgcctacagaaaggaagataatttgcaaatatagtttacccaagctgaaagggtagtatttctcacctaattaatgattacctccttagacaggagcaccactacacaattatttgctactattccactattttgattttctattttctaacacgaatcagacaggtgagatcagaaacccaggtcttctaatgtagctagctgactatggaccacagcattgtaagagaaacaggcagggtgatgatctagaaagaatgcgaagacctgggttcatgtcctggccctaactgttattacctatatggacttgggcaactcacaaatgcctggagctaattaattagttccttaatctctcaaatgaacattataagggtactaaattatatctcacaacagtttctatgaaacaataaaatcacactggattttatcataggagctctgtcctctgtggtgacaacatacacattagtgattagctactacattccagtgcagctggtcatttcaatgtgcagaacatttaatatttgtaacttgaggaatgtcttttttaatgatgccaacttaatgcaatctattatgttactctttatatattgagaggatctttagattcttataatgcaatccctttctaggttggtttttaaatagagtgcacagacattcttacacataggttccttccccacccccactgcttcctaatgatgcaggattttccatgacatctggtctcagtgtcaacaaccatttatagcatatcagctgtaatgagcagcaactgtttccaagttttgttctgtactttcatatgaatacaatggcaatttctttcaatatgattcaaagttttcttgaaactgttcaaatgactcaaagtacataggcaggttgatggaatcactttcagaactggaagagacttgggagataaaataactcaaacctttccgtttctacatgaggtagggaggcccaaaaagatgaagctgagacctgaagctagattttctaattccttccttttaaagacgtgatactaaagaagctccaccaattgtataaaaagttatttttaaaaggtagtccattcagcagatgtttttagaagaatttgaagtactcaaaaatatttactacccatatccaaaacttatgaaaaaaacatagttttaaccttgctttaccaattatcataatctttattaataaattgatttggcaaaggcaatagcctttagcattaaccatatcaggcttttatttgtgcacatctagaagatgtgccatctaaaagactcaaccattaggaatatatatgtaaaatcatgtgtgttttacttgtttttaaatttttgaatattataaaaagagcaaattactaattttattatcccatattatttaattcttaaattcctttggatattattttttaaggactaaaaatttgtcttttaaaatttctttcctctattggagaatctcactcttttaacagaaaaccatcctctgcttggcatgttttctgtcacttatcttttgccaaagaaggtgcaaatgaagctccccaatataaactatttcttttttttttagttttgcatgaattgaaaagcttgaatgtcaagctcacttgtctcatttgtatacatggtacaagggattttagcttttatttttgtgtggaattaatgcctgaattcatgtacttagcacaaggagtttctagcagatgtatgtgctataagtttgcaattaggaagtactctttctattgctatgcatatatgagcaagttcataagaatccttctgtattccattcctgtttattcatttacttccacattatcagcacacactgctgggtagactgaaagaaccagagtgtaactaactgcagtgggagagtgccaattacccacagcttctccactgcctgacaaacactaggcactcaacaaagaaatactggaatggctaaatgaattattaaatttatcaaatacatactttgtttcaaaaatatctaaatatacatacacagatgatgtgttccttaaacttttatctaaacatagctctgagaaaagtataatacttgtgattttataattatccaaaatataaatttcacaggttgatatatctactacccatggttaacaagaatttactggccgggcgctgtggctcgtgcgtgtaatcccagcactttgggaggccgagacgggcggatcacgaggtcaggagatcaacaccatcctggctaacacagtgaaaccctgtttctactaaaaatacaaaaaattaatcgggcatggtggcgggcgcctgtagtcccagctactcgggaggctgaggcaggagaatggcatgaaccagggaggcggagcttgcagtgagctgagatcgcgccactgccctccagcctgggcaacagagcgagattccgtctcaaaaaaaaaaaaaaaatttactaagtacttctcatctccccccttccctgaaaactaattcctttctactttggtcataaatttaatttattcctatgaaacagccttaaagttcccatcacatctccaaattctcttcattaaaatctctctctttctctctctctcatattcatctatccatccgtccaatgacatttccattaagtaatgttcttctgaataggggctaatagtaaaggcagcattctctgccgaggcaattcatagggtgttaatttgttgctaaaagattcagttgtgtgtataaagcctcctatccagattgttgttcatgaaatagtttagtaaccatttcgggtacatttgaactgcagaaatcttactaccttgtttcaaacacagttatttgaaaaagcatagctttataactatctcctttacttattctgtcaactaagtcatagaaattgtattctccaggttcttaaatgagaaaatatatctgatctgacattcctttatttcttgtgacattaaaaattgtcatttgttactgcaacctcactttgacctaatatttttctgaatgcagtacttgtctgaggtacttcctcctttctgggaagaacatcatcaatatgcttttcacatatgtatatatattgattttttttttttttttgtagggatggggggtcttgctatgttgcgcaggctggtattgaactcctggcctcaagcaatcctcttgcctcagtctcccaaagtgattggattacaggcataagccactgcaccgggcctacatacatatttttacatgatccttaattcaatggccagcagggtttcatgcacacaaggtctgttcttgttttgctcagtaatgtatgctcacatttaaaatgatgccttcgtggttcctgaaggaatgtttgatgaatattcattcttctctttttgtatttgaactttaaaccaccaattcacaaatatccaacactgagttacagcactcagctcttcataaagaatctatctatctatcaagtttatttatttatttatttatttatttatttatttatttttgagacagagtctcgctctgttgcccaggctggaatgcagtggggcgatctctgctcactgcaagctccgcctcctgggttcatgccattctcctgcctcagcctcccgagtagctgggactataggcgcccgccaccacgccccgctaattttttgtatttttagtagtgacggggtttcaccatgttagccgggatggtctcgatctcctgacctcatgatccacccgccttaagcacccaatactaattgtcttcatgtggcaattactaattaaatgtggcaaatgcattttattcttctttgtctcgttttccaaaggctgtggtcaatgctaccttactgattttctaaatgaaaaagttttacttcatacacctgtctactaccagattgtactgccccctactctacattatatcttattttctttattcccaatgacacagattttgtttatctctggaagacccataggcaggactattttaaccttttgattcactaaacttagaaccatttccacaaattattgtggatgttgctagcaaaattattttcctatcgttttgactcattctttggtctctttacaggcttttaattcatccaaccaactaaattgagaagtagtagttattaagcatgcagacttggaatcaaatttcttaggcaccaatcatattttactagttgagtgatcttaagttctttcatttgtggttgctaaattttcgtttacatactatgaggatgatcagagcaccttcctcataaagttgttctgaagatttgtatgataagacagcacagggtacatggtaactgcttgataaatggcatcttttaccattttgcttattaagaccctgacttgatccaaacgctcccaaagactgcagtcctatccctgaactgtactgtactgtttatcaccaccactagatcctcctaatattatctagatctacattaattggcctgccactggacacacctcagacaaaaggctgtggtccatgtatccactaggttctgcctggtgccgatggatgtaccttcttgatgctgatatcccaccaccctgactcttctcctattgcttgtttcagggacatcctgaaattgcctgttgtacctcagtcttgattataggtcctcataatttcccactgtctaatgagccccagtgagcagcagttattcaactaaatagtgatctttattctgaagatatacttatcttctttatgttattcaaatattaatgaacacttaataagctattttactgaatgctgccttttatattatagatgtacttttggttgaccttcattcatttctaaattgaaggaatatgctgcaggtattggccaggtataagcccctacgttaggtactgtggagtatcgcattacgttaaacagctatggttccagagggcttatatacaaattgtacagcacttatatccttataggtgctgttgatcatgataaacatgacatttcctgtgtttctttttctcactgatgtggacaaattaaactatgtgcatcaaacatttctatcgcacatcaattaacatattaattagtatatggacacaaaaataaatagcataggaatagtaaaggcaagtttttgtttaaggcctggtaataaaaaatttcagcacttgatctttttaactttactatattggtaaacatgctatcacaagcaatatatttatcagagtatacatcatgggtataaaaggcacaaaacaaaggcagggatttggcacgttcaagaggttcatcaactgcctctaatgcacgtgttttgaactctctcagtgtgtttatgaaatggcctactgaagcaagcactgagaaccagactcaactgaaatccatccaagtcagcaatttgacacaaactaagacaacaactaaaaaaattataacaagctctctcaaaagctcatttctgtcctttcccagaatcagaataagaatggagagcaaaagtactttccctgccttaaagaaatctggtggggaatgcagcaagttatttcttttgctagtaagcctccctaaaaatcatctgcttaagtttttaattagtgacgttagctcatacgtcagagaatatatttttcttcacagcccatgtcctattaaagttccagtctttgaagtgctcacctgattccagatgtttagagaagtcctgtattacgattccacaaaaaatatctttaaagttatggaagaggattcacattttttaatacttggcttttaaagtccacttatggttatataacatggagtaaaatgtttcaaataataaatttatagaagtgtctgaaaaaaaattgcacaaatgatgtgcatgttcatatatgttcacttaaaaggaaagtagtgctgtgggttctgagaggtaacaaaaggggctctgtctgtaaatggccagtaaagaatttttgaggtgactgtaaaatacatgaattttcaaagaaacacactgcttttgctttatactaatgggtacatttggtaagtgttagcagatatacagtccgatcttggctcttcagaagaaaatgcccttaaccatacctttgcttttgatatttaaaactctcagaattaaatgaaatcaaaagattgcagaaaactaaggcaatgttttgcttataaatcacatcttcatgtaattggtttagagatatagtcttctagaacattaagtgactggaaatatggatttataattttttttataaccagaaaagtctgcacgtgagaaataagtctaggtcctctcactaaacacacatagttttagacattctaaattatcctttgtcacctttgtcctaatgcctagaaaatgctgagtttgaaagaatcaaaactatatacagtgctcacatttactattttactcatccagtagtttttcttttcgatttctaggcttcactatttttctgaaattccacaggtaaaactagagtgctgggaaatggagacggaaaattaatgaaaaagtactccccttgtgagctatttcatttctaaatgatctaaaaattctctgtcctcaagggtatcagaagctgagtgaagtcttaagggtatcagtaggcattcaaatgagaatatgtatatagggatatccatatatatttgctacataaatattatttgatgattaaatttgttttgctttctttacatctgtagttttagaagacactattatcttggtctttaggaatataaataaataaaaaactaagaggcctcagtgtcctcagaattcctaggactaatgttaagggaaagagaatgtcagaattcaaaatgaggttctttagcacataatcgtttaggctaaaacttcacctaataactttatctctacacactttataattttactaagtatttacataatattgggtatatatcacatgaatataaaatgtttgatcaatgtacacagaacaaatttagagtgaagatcatcaaaccctactgaaagtcacattaatgctatatccatccttacaaggaaagaaatatagcatcctatttattgttaatgttgggaagttatttctatctggataaatcaagatttatatgtctcaagtgtgtgttagagatgaaataagagagactgtggtgagggaaagttcctgagtaacgtgctggaataagtccacacaactttattgctcatatttttgcctttacaggcataattgcagctgaacagtcattaggaactgtgtggtggtttatcttcttcaaccgcattactcaccttcaggtcccgatggaccacgcccatctgatggcagtgtagcacagcctccaggatctgctgaatgcaatgactgcatgcaaacaccagggggcgtgtgttagttccaagcttacactcactgtctgtataccctcagagagactgggttaaagtgcagagctagcagacaactggggttgtattgtaccaccttcagtcatgtaaacatattgctcaagtagagtgactactacctcagaacaatcagatcttaccagatgtgagccagaatgtgggtccatttgttctagaaaaatccattttgaaaacactttatgtcattcaagagatcatttcctggttataaattcttccaggaaataaagtggaacacaaatataatctttatagctgtggtgttccgcctccaccccgtcacataaattgtttcccttttctctcccatttttccagtattgttctaaaagctgtcacattaacagtcagggcaccactaaggttaaattaagatacctaatgaatttttgataaatcattaacttcttgtgctttaatttagctggcaattaatatctcttgcctaagggttcatcagactcaaatggagcaatgcgtaaccagttgttctgctacagcaacccatggtctcagaacagaagtggtgtttaaaatctacaggcggacatacatcacaggccaagtttatctccaggcaaatgctgggcaattcaagaaagcctgctcctcaatcccttttggtaggtagtttactgcttggaaacttagcaggttgtattctttagtattcttccctttttgctatgatgtatatttagcctgtagatgagcaaactggaagaggcatcatgcattatcatttcatcatttactcattttagaaacaagttgggaaaggcaagggaaccattttaaatacccaccctctgccctttccccagaaaaaaaaataaaactgctttgattcagatttatggactccatatactgaccttcaggtccctgtgaactatgccatttaggtgacaatgattaacactttctagaatctgctgtatacaatgactgcaaagatacaagggcagaatggaagggagaacattttaaaggcacataatcacattgaatatgaaataaaatgaaagtcccaatgaaacaaacaaacaaacaaaaattatatttcttcactttttttagctttacgttggaatcaaataaagctgaataaagctaattttggttctaacaaaaatgacatccaacatagactttgtgacatgttcagacaaaacaatttgagttgtgttgttttcattgtaagtgtacaaattaaataatatgtataagaaggtaaaatctccatatttagaaagaaaaatttataaagaattcccataatgttctgggaaaattcttcagagatataaaatttccaggtatttcttatacacatctaaactgtttaaaatctgaggtcacaattaaacaggtgttgaaacaagagggtaaacacagatgaagtggcaggtgaaacaagggtcaaaaaaaatggagggacacatttaccatttcgccttagaagcgttgctttttgtaaagtatataacaggaaaacaaatgcaagtctccaacaataaagggagaatttaaagtaaactcatgaataaaataaacccctctttagtgtaagaatactttggggaagagctagggagctttcaaagaataaataaatacaaatttacaatcccctggagcattggtaattattaaacccacttccatacacttcagtgaagaaaaacttttgcttcatactatatcaaaatgcacattttatgctattcttattaagggttcactgatatcaaatgggactgctaattagagaggagaaatccttgtttggcacctataaggtcctgtgaactgtcatctgacatataataatgcagaacacatcacactgatgaattttgtataagttcactgtgcaattcaaatgcaagtacatcctgaactacatttattcattgaaagatgaagcaaacattttaataaggacattttcaaccacttaatgtataaaataatattattctaaagaaaaatcttgaatttaaaaaagtaatcaccatctgatttattacaatgtaaatattttaaaaattgatcatgactatgattttctagctcttttattaacaataccactaaaagcgtctcacattcattgctgttgactacattgtttatttgagtattggtcattatttttaaaccataggaatcttttttcttttacaataatgttcactttgcactactctttaagaatatttctcttcctgttctcaaacaacaagcataaattattgaatcttgggaataacagaagataaagaagtaaacaataacacatactaaatggacttcaccattttttttactagtgagaatggattcaattcttaaatttttgagaactagtaaaaaatttttacaattttttgacaatcaaatagcctcttttgagacagggtctcactctgtcgcccaggctggagtgcagtggcatgatctctgcagcctccacctcccaggttcaagtgattctcctgcctcagcctcctgattatctgggactacaggtgcatgctgccacacctggctaagttttgtattttcagcagagacagggtttcaccatgttgcccaggctggtctcgaactcctgggctcaagcaatcctcccaccttggcctcccaaagttctgggattataggagtgggccaccacatctgactgagaaatagcctctttatgtatttagaagggaatgttccttctctttgattttatcggagagctttcataaaaaatatcttagagctctttagcagtaaaaatagtctctattttaatttcaaccagtatttttcaaaccaagtaacagcctgcttaacataactttgaagggtaacattaatgaaattccctagtttagtaccttgattaaaagtattactgtttcttggcaagtggccaaatagctacttccagaggttccccatggcccctttcaggaccctaatgtggggatttggggtaaactgagcaagtgatgattcactcatcatagtataaattacacagaattttctatttgactttggccataaaaattccattaaaaaattagagcgtagtcatgtacagatagattcacaaagtgccataaacagtgcattaaaccaagaagaaaaattagaaacttagaagtgtgcctctgagggcaaggaggggctgggaaccttaatatcagctggacatctgttgagggtcaggctacaatgggattagcaagccttgggaagctctgatggcattggagaatgggagcagagtcaatctctgctcccaaacatctcatttacattgctaataatgagccaatcactcttgatcagatttttaaaaataaatgacagctacagaatatataaaagtacacaggaaaatttacaccatgcaatccagtaacatctaagcaagtggttaatgttactccactccaaaagtgttgccttggatagcctaggaagttgcaaattagacaaaaaacttagccttttttaaacttttgtaaagattttgccaattaacaagattgaaaaattactcttgaactctcttaaatgcctgaataaatatatttcaactcaggggttcaagggttttaatgaaatttccaaagagttaattagctaataatagttccttaaagagaccactgagacttttttcaggctgtttctgttttctgattagatattcattgttcagtagaactttctgtgatgatgaaaatgttctatatctggtctggccaattggtagctactagacacttgtggctactaggcagttggctagaccaactacatggttagaccaactgagaaataaatttttaatttaatttaattttaattaattgaaattgcaatagccacatgtgactactggctaccactgggcaacctagaatctatctagggattagaggatttcaatctttgatctctgactttcactaaaaaatatattgctttagcagaagtcattccaattaggtggggtgttttggtttgtttttccttgttgtttttgataaaatatgtaatctaactacagatgctagataaaaatatagaccagattcatggagttttttttctctaagaatcatcccggagatccttaaaacatttgtttgtacaaacatgcatttgtaaagaaatatgctgaaaaagtattatttgaatgttgagtcttgtatcttgcccagggcaagtcacttacctggcatcagcttcactgtagtattctcttgccactatgtcttcaaacagttcacctccagtaactctgggaagataaaaaacataatcacttttaaaaagaagcaaaaaaaaataagcatcaatagatttgcaaatgtgttcatatagctgtttttcttagatgatttaaaaaaaatcaaaactttttaaaacatgagacagtgttcgtaagtcaaatctatactacactaaacatttttatcttttttatttgtctatcattagacacatgaggtcacaattttctgtatgccataaatatagtaggcaatatctttcgcagaaaatggttttcatttcaatttttcaaatattaatgatatctgacaaaattttggcacagtttagaaacactttctgaacaaaaggagatgatacacatcatagctattgagtatgagtttccatgtatccttttgctatttttgcatgtgtgcatccttaaacatgtatttttccccttgaaaacacacacataaaaatagatgcttttcccacaaaagtgggatcacgtgctatatgtaaataattaagttaattgtatttgtcattttacatgaaattatgggcaccatgtcatatcagaagcattttcccctaatttaacgtaacatagcaattaatagagatatgcatatgcgtacatacatgcgtgcacacacgtgtatgtgcatattagagggtatctctgaaagagaaattcttacaagtaaaattactgggtgaaagagtacccacatttaaaattttgtagagcagacagggcaaatcaccttccaaaatggttgcaccctgaaaattgtgaaggtgctcacagacccaaatcattactaataatagttattattaataaatacagaacacctattcaattgtggaaaagttaatatgaatttcttggttattagcgaggtagatcattttctcatttatcaaccatttcttcctctgctatgatctggcttgattttaaaaggacatttcatctttggggtttaaccttgtaagagctaacatttgctgagttcttacaataaaccacacagtgtactaagctttatattaacttataaatcctcacaattgcccgccgagcaattcccctcccagtttattgatgagaaaatggaggcccagagaagttaagtaacttgcccaagatcacacagcgtttagtgacacaggcaggccatccactccacagctcatgccctcaaccactccacagtgcagattttccaataatgacactgccagtctttccagtttagaaggcatgagtcatttggaaaagcatcaagtaaaggtatagagcttcatgtatgaatactatagagtgagataaaaggatgctaaattagtttttctttttgttcacttgtttgcttttttgctttattaagttctgaaacatcatcaaaggatagcatgttttagagatcaccagttagtattctctcccttattctcctttccaaaaggaaaagatgggatgctaaaaattataaacatgtctgaacatttatgcaacttctgcctctcttaattgcattctggatacctcaaagtcctttaacgtccgtcattatttccaattctattattttcacatataaaatgtttacctaagattatcatataaatcttcatataggcatgttctaaaaaccatggttacatgtacgtaattccatttaatagcatagctatttattccgattagaatctataataaggcaatcacacaatgtaccttacataaattacaatgcaaaatagttagacaaaaaacactttcaacaagtctactgttgcctgtatagtgacgataacaattttgtgagatttcttcctttgaatgtgactgatgtattatagatataatatatactcgtagttatccttgtttttgactataagtacctagaaaacctacatacattacagacaattttggattgttaaaatgtttaataaacattgattaaagtctactgacattaataaaattgctgctatttataggctccttaaacatgttatttggcctatgaaaaataccagatcctggatcactgggctctcaacttactgatctttgttatgttagcatctaacctagcattaatacatatttgcttaattaatgactcttgaagtaatgattaaatgaattaacccagttagagaatcatgctatccatttcatttactgtaaatctgaactttacatgagcttaaaaaaaatcatacaaataccaaagtttagctatacatggcaatagattttatttcctaaggggttcgtatttaaaggagaatatttaaaaagtcagggggactagcattctggtagttttcaataaatcataatagctttagacaaatttgaggggtgtagagtttcatgttgagttttagattatgtagttaactgtgtctgacaacattctctctcctagtattcattcgtcccattatttaaaaatatctttacacaaatgaaaccattttatcatttcttctatatgtatgataaatgtctgaaaaggaaaaaatatcagttataatagaattcaatgtcttgaagagaagctactgaattttctaactttaacatatttttatactcacattattttttaatagaacacaaaattaagccatagttattagatatttttgaaaatttttactgtgctttgtgaaatttcatataatgcccaaattaaatcagtctcatgaataaattgttaattaactaattagagattttgtgaataaattgatgtcagagttctactatgatatgaaggatatcaattataaatttgaagcattaattaccatttatgaaatctccagaacattagggctcacaaggaaaaaaaaagataactctagaacatgaaaaaatgagatatgtatcagaaagataaatatttgttactgttgttatttatagtgatgttgattcacactgtattattaccctgtataataaattgttcttctgtttctagtgtacaatttgcaattcccatcagaaatggtcaaaattaatttcatccagaatacaacatttgtaaaatttcatcagtaatagatctttgaccatgaggctgagcagcaagtagagtcaaagactgggatttaaaaaataaaatggtgccacattaacccaaggaatagcactgacttggagattaaaagcagtgctcgaggtggtgggggaaagccaggaacttcaggttggagctgatgggaaacaggaaccaagagcggcacccagttaatgcacaagtaggaggcaatcttgctaaggtaggactgggactaactctggaaaaaggagtaatttcccctgggaaattaacttaaagctgaagaacaaacctagtgagatgagattgccagacctgaaatccaagcgtttgagcagtggtaacagaggttcattaagcagttaagcgaagaatcaccacaatcagatttttatttgtaaaaaaacatatctcctgctgccttgcatttaagcaattggtatctcttcatttagtgatgaaggcagaagttgtaatggtgacagattcatccgcgtcacctgcatggtcatccaacacactgtcttccacttgttgaacaataacaataacaataaatattcattgggtgcttattgtgtgtgcaactacctggatatctgtgccccctccccaattaataggttaaaatcctaactcccaaagtgctgatattaggaggtggggcctgtgggaggtaatgaggtcatgagggtggagccctcatttggggtcgttaccaaagggactccagagagctctctcctctcttttctccgtgtagagatataagaaaaagtcagtagcctgcaatccaggaaagagcccttgccagaaccagaccacgctggcacgctgatacgctgatatcagacttccagccttcaggactgtgagaaatgtctgttgttcaagccacccaagctatggtattctgttaagcagcccaaaagactaagaaaatgtgccaagactaagtgctgttctaagtgctctagagattgcaacacagcaaccctatgaagtagatactagtgctatttctgttttatagacaaggaaatgaaagtaatggagattaaggtcatttcccaagaacacacacaaaagaaaggaaaaggactagctttttcttgtctgtgctgccctactagcttgccccttggacacaatttggggagcagagaagggtaagacaaggggctcggaataccccaaaggatcatgcagaaagactgggaagaatacagacataaagaattcccacttatgtgccctttaatcattgattaaagtcagacagtttgagtactggtgagggcaggagagtagtcactggtcagtgtgaagctgatcagggctcattagtaggagtgttactgggtgtcttggctggatgattctatattacgagtgtgcagatgtcctgtataaggcaagactgtcagcaccaggccctgttctaggtgcggcagaactaccttgtcagcgtgccaaccagtgtgccaagtccatccatttctagttaccccaggggctccccaaagacccctgaagggaaccatgtgtctaaatgaacaaagtctatggggatacaatgaaaaatgtgggtctccttagcaccatgttctaagatataaagtaaatcaagccaaccactggtgtaagggtctgtcaggcagagcacatgaccgataatgggacattgtctcttcagcaccttacacaatgcctggctcacaggaagagcttaataaatgttttctgagtgaataagtgattaaataattaaatgggggaatgaaactataagcaccacttcatgattttctggtttgacctgttatttgagctagtacctcagggtgaagaggcccaaccactttttctattatgtaggtacagatctctaactaaatcttgctgattatatctccaaaacaggacttgaatcaagacttctatctccactacaatgtcaccagcctaagtctctgctatctctcacatgtaccactgcaataactcctaatgggccccatttcctatcttgccccccagcccccatatcaactctccacacaatagctttaaatgtacatccaattttgtcacatgtctgcatgaagctcttcaatggctgtacactgatttttcaggccaactcctgatatgaccttcatgtctccgcttaatttgtatcccacctatcttccaattgaggccctctctttcttgctctagttgtgatggccttcctccagttcctcaagcatagtaagctccttcctgccctagggccttttcacatgcttgtctctcttccgggaattcccaagaacactcatggagaaggagaatgtcaaatttgaaagtaagtggtctttctgcagtgtctgtgaggtgacagtcatttatagcatcctttctatgtctttatggaaatcttaataatgaattcagggctgtgcaagctgtgttttgcagattagctcttatgtcttaccatagtacttatcttttttgatttgaggctggtttactgagtcagattacctcttcagaagcctataatttgtaactgcatagttttgcaccagtcctacccttagctccccaaaattcccctgggcacatatacgtatattatgagcatggatgagttgatataataatgcactcaactctttggaaaacacaacagctgataccagagtacctgtgcatatataaaacacattttaaaaatagaaaaacactaatagtctactcagatagattagtgagtgccctgatggggcattaggcttccctgccaagcataacctttggtccctgagatgtacagttcttggagttgaacctgggcccagacccaaagatgcaagacactcttttggaggtgaggaatctggctgaaaagagttggttacatactagacccagagttgggcaacaataatctcccattaaagtagtgagacaaaaggagaaataacacactcacgtaactcacaatgtagttaaaccacatatacaaaagttcagttttcataatcaccatttaactttctgcttcatctatccaagctaactgaataaccaagtcacatttttaagagttaattttcatatatgtatagtaactgtttttaattcttgaagtcattaatttttattggccccaatatttttagtaatttgctatcaataatttttattatggcctcgatatttttagtaatttgctatcattaaattatatatgcagttggccctctgtatatgaggatttgacaatggcagattcaaccaactgaggatcaaaaatatagtattcaaaaataaataagtatacaggaggatgtgcataggttataggcaaatacagtattatgccattttatatcagggacttcagtatctgcagattttgttatctgagagggtcctcgattcaatcttctgtggatagtgaggaacaactgtaatacatacatatacacacacatacactactatgtcatgtgtgtatatatatatgtaatttcacttataaaatactgattttgccgggtgtggtggctcacgcctatactccctgcactttgggaggctgagatgggaggactgcttgagcctaggagttcaaaaacagcctaggtaacatagtgagagcctgccaggtggggtggtatgaacctgtagtcccagctacccaggaagctgaagtgggaggatcgcttgagcctgcgaggctgaggctgcagagagccatgatcgtaccactgcactccagcctagatgacagagcgagaccctgtctcaaaaataaataaatactaaaatcgaatattaatttaaagaggtaaatggaagattactaacatgtcatgcatttcaaacgttatctgacctatatactctactgtgcattaaaaaaaaacaaatgaaagaaatcgctgtatatggttttgcaagcaccacagacattctaaagataacaagaatatttacaaaatatattttaaaagaatagagaagtccatctaattagaaacaatttgaatacacagaggaattatgtattaactattggaattcggtaagcctatcagataaattaaaatctcaatacctatgctatctcttgtcattcactagactaagtttcaaacactataatatggacatgattatttttatttatctatatgttaaaatcattgccatttaaaaatcccttgtattatcacattttttgctcatattttgttatttattatgcttgggtaatccttagagaaaaattataatcacttttaaaaatatctgccattggctcactgaagaatgttactaactgagcatcattacctgataagctacatattattaacgtcacatgtactgaaacagcctaggaatcctaccagggttaggctgaaccttcctgtgcatgtaagatttcactgttaatgccaaggcaactgcctttgactgaaaacatcatcacagttaaattgtgtttcacacgttaattgggatgaaatcgtttctgtgtatcagtaattcatctaaaagttagctttggtcatcagaaaaatgagcatttatttagccacaaaatgtgtagatcatgttatgaaagcaggaaagctactgtagataatgggtgaatttataccccaaagttcagattctaacatatttctaatcatcaatacttcagaaataatcctgaaatagaggtgacagatgagtgaagccactgatttgttgatacgcccctatacgacaacaggttttccaggttctggaacattgggggtttcaaagatgtcagacaagaagagattctatcatttatcagtcttcaatactcagaagaccaacagatcctctgctggagaggagatactgttactgttgatccctgtgagtgtgtagatgcttacaaaggaagggctcaggctacagtcggctgaaagctatttaaatggtccttcttgttttgcggataccaggacatcccctaccaagttctccagtgagcgactcatttgttctcacagcatttttttttttttcctgaaaatacaaatagcttcatggagagttaaactttgtcattaagcagtgtcgtttatctactaattctacaaatattactcaactttattcataatatgtgtgagctttgcccatgctaatggacaagaatataaagaatcaagttgtaagctctatcaagcatctagtctcgtggagaaaatagaaacataaataaaaaattatgttcctgtggaacatgctttaaagcataggtctatttttaaagccataatccttaagacctagcaaatcctagactcaggaattgtcccatttacagaggaaatatgtatacttgtaagtaaaaaagtttcacccaatacttacctttttagcatgatgaaaggaagaagaattagcacaactgggacacatgtggactctatctgtgtagactcactgatgaatacacagtaacatccacactggaacattacaccaatcagtgccccatgccagccaggaaggctgggagtcttgctgcatcttgtcacttattgcagtttatgaagaattcttgctatttcccctatttcctatgcttcctagagggctccacaccactgctatatagattcaggaagttactccatacaaaggataagcaaaaaatgaagaggaaaaaatagtctcataaaggctaagggaaaagagaggagagaataatgaattccttctgtgggtcagagaaactttcatagaggaggtgctatccaaggaggaccctacataaatgaggaagagttggccaggaagaaatgtgagacatgaacacctaggaagaaacaggagttcaactgcaaagaggagagaaaaaaggaacaaaagagttggaaacaggaatctcaatttccccttatttgatctctaactttcctctcattcctcacaatattcaggatatattttattactacagggacttacaagataggtgtggtggctcaggcttgtaacctcagcattttgggaggccaaggcaggaggatcacttgagcccaggaattcagtctgggcaacatagtgagaccccgtatctataaaaaatttaaaaattagctggacatgcctgggcatgcctgtaatctcagctactcaagaggcttagggagaaggattgctagagcccagagggtagaggttgtagtgagctacgatcacaccactgcacttcagcctgggagacagggctagaccctgtctcttaaaaacaaataaaaaggcttacaaaagctaccttttcccaaatgtgctcaacattctttttggtatactctagtgactgtgttttacaatgaaaactagtagctcatttctagttacataaaattttcccatttatctgaataaaggcttaagtcaatctagacatttttaaaaagataatgccagattaatctctacacaggcttaacagaaacgatgctttctgaagggatgtctgagatagtaataccattttttaaaaaaagatcaagagttattgccggttttattcccaaccttttgattttgtcagtagctaagaagtgacttagtaattgtttctaggtttaacattcatgctcacaagttcttcatgcttcagcttaagtgttctgttgccatgtactacacatatcatcagacaacagatttcttattttttactggcaatatagttgggtctctggaatattaccaaatggtttattgtatgtgtgcctgcatacacgtgtaaacacaagcatacacgcccacttagtaagcattaaagaaaagcctgatttgctctagtaattttagctgactttttactggatataaaatgttcaatgaattaaaagaaaaagcatcactgtaaagctgcataattcaatttaatctgaaaagagtctagtctgaatagccatatttctaaattatggaatatttttctaaggaaatgaaaacacatttcttttaagtaaaaggtgataaagtcttatttgactcctttacaaattataaattctgccagagctccattaagaaacagccaagcagaggcatgccacatgcaaattactgtgttaagtaattatctaaaatcttatttatactcattttctaagcacaatgcctatttagaatacagagattgaggtaagtctagatcattcaaattattgtcaatttaaaaattattcacttattcatgtatttgtgtgttacttatactacactatcttcttaaagggatttgagacagcttatcatctgtcaaatcatctaaattataaaatttccccatgtgatttctaagtgcatgcttttttctttttcaggctaacatacgaaagaaggagcaacagatttatacttaactgcagcctacaaagatctatacagccttacattgcttccatttttaataattctaacagttcagtaagacaaatgtgcttgattttaataatcaattgttcattgaatcaaaaaacatttgttgctttttatgtgcaagtgttaggcaactaatttactgaaacttggtttaatagtttggttcaataaattgttttttaaagaagattattaggtttataggcatatatggctttatttaatttaatgaatgcctgcaaaattacaaactctttattcacacttagtagtagctttgtcactattcaacaatacaacaagataatctttagctgtggacttaaaaataaaatgcattctggccgggcacagtggctcacacctgtaatcccagctcttttgggaggccaaggcaggtagatacactcaggagttcgaggccaggctagccaacatggtgaaaccctgtctctactaaaaatacaaaagttagctgggcctggtggtgggtgcctgtaatctcagctgctcaggaggctgaggcaggacaattgcttgaacctggtaggtggaggttgcagtgagccgagatcacgccattgcactccagcctgaatgacaaaagcaaaactccatctcaaaaaaacaaaaaaacaaaataaaatgcattcttacacacataataaacacagtatttgtaggcatcattactgacaaatgttaagttactacaatgcaaaccaggcactctagatctgggtactgaaagccatttaatgtgtgggttttctttcattgagagctttctttcactttgtctctcatagaatcctcacttttggttcttcctatattttctttccccactccctccctctggttctatagggaagggcgtgttgccaaggtactgaaccattttgctggaccctaagaaggaaatgaggatgtttcagtgtttccaactctaagatagtggttcaatgggtagtttggtggatggtgctatcccacagatttctaatactggagaaggaaaggtaattttcttggaggcacttcttgggatcaatgggagaagtgatgacagaatacaattatttttagttgatcacctggagactatctatttagccacattattcaagtctggagtgtatctgtactcaactattgtgttaagaacagtacaaataaacaacttcggcacagtatcctatcccacccaaatatacttcatgtcgagatttatgtttcacttaagcaaattttaatggtaggaagcttcagaaaaggggaagagggaacttagtgaaaaatattacagactgatagtgttgaaggaagctaacctagaatttaaaaaatccttagagaatctatgaaatagagactcttgatggagataactagtttcttttaaactctcatttgtgactattaaatgtctacttttccatttataaaatgttccctatattaagagtttttatactgaagcaattttactaggttcatttgcatacgcatacttaaagctcagtttcaaggtatcagtgacctcctccttggaaagctaacactgattggcctagagtacatagtttcaggcctttaccatgacatgcatggacctccataacgtggcacactcttactgagctctctccctttttaattccacaccaattaccttgaactttggttagttgcctatttcaccaagcatttttaatgtaattccttgctggtaacgcctagctaggcaatcttgatttaattttccatgagcttatacattcttcaagaaagagcccaagtttcctccagaaatacttctctgaaatccacccactgtgctttcacagcatactgtgcttgtttgatttaaatttcacaccgagaccatctgcttatatacccatatctcctactaaacctcaagataaggaaaggcaaggaccatgtcttacttatttttggtatcccttgaacctaacatgagcctaacacattgcctgagacatattagcagctcaatcaacattaattgaattgaacagtatgcgaaagggaagatgcaatatgaaatcagttaaaaaagggaagtggaactacgggtattttttattattaacattttcctttaaaaggaggatttaaaactcctattcttctagtcatttgcatatttattcttttaacaagtatataccaagtgtccatgtattagagcctatattagatgaggaatatgatggcccctaaattttaaaaaatactcagaaaatacaaaatgtaataggacatcaacggatataacagatatccatgtgatacataaaggatatcaattcaaattttcaaagcatacatgcttggctattactacagataagtcagttgaaacatcaaatgaaagcagttaagtcagttcaaagagtcttcagaaaaaataataacatttaaccacaggatgtggtcaatctcctgtcagaccacaaatagtcaccagctgcagataagtctatgattagaaatgttttcagccagcaccacagtgtattggtttgtgaaagagaacaggcaaggtagggggttggtgattagaagtgaagctgggtggccatgatcctataaatttacccattacaacaaattaaagagggcttattcaaagggctgtacaatacctctctattttggctgccaaatgcttagaagagttactttcacgcagaagtcaaaaaaaaggctggccatggtggctcacgcctgtaatcccagcactttgggaggccaaggcgggtggatcagttgaggccaggagttcaagaacagcctggcccacatggtgaaaccccgtctctaccaaaaatacaaaaatcagctgggcgtggtggtgcatgccggtaatcccagctactcaggaggttgaggtaggagaatcgctcgaccccgggaggcagaggttgcagtgagccgagatcatgccactgcactccagcctgggagacacagtgagactctgtctcaaaaaaaaaaaaaaaagaagtcacacaaaaaaaacgaataattgaacacacgtgtgcaagataagatgccatagatcataatctttgccacccagatgacagaatcaccttaatttgaggtttaaatcacttttgggaatgttgaaacatggagaaaagacagaaaactaggataaattcactttcctggccttttctgaactcaacagtctgctttcctacagaatagaaaaaaaattagtagaggctattaatgagttcagagtttagatgcacttttggaagattttgtggtgttatttgatattctaaaataacaatcagaatttctacatattttcatcattgtaaaatgttttactttctattatttattctgtgaagttattattttttcttttcaatattatcttcagttgccactaagaataggagagtttcatgctaaagggggaaggctgaagagaagaaacgtctctccctttttcacaatggaaagtagcaaaagagactgttttctgactgtgaatcagcttagtaatactggtccagttcaaagagcaggaatccccttcttttaaaaaccatgtatcttcctaaagctctgaatgttcaattctttgtacttttgcaatatatgtgtagagttcagtcatttttaaaagtccaatttaccttttgaagatgaaacataagttttctcctctactgctctcacctatgcccaaatcattgtcattttttttctttgactcctccaatatccattttcctccacttccattctgccctcctataatcccttgccacactgcagcaagagagagctttgtataatgaaatcggattatttcatatttccgatctttaaatcttccaacacctttctagaacacacagcataatatctaaattcctctttctggcctacaaggcctttgagctctggcccacacctatctcatgtattatttcatatccttgcaccctaggacttgggatgtttcatgccacactggcctttgttctgctcctcattgaagccacattttctcagggctgtacccattgttcacactgagtggaatatctactcacagatcttctcaacatttaggttcttctcctgaaacatcatagcaaccattcccgatcaccctctaaatcagccatcagcccctagttacgcaccaaatatcaccctgttttcttcatagcactagaactaaaatgatttgctgggtttctttggtcatttactcattatccatcccctcctccttcaactactacaatgtcagttctgtcttgtccattactgtattccaggacttggcagagtatatgcatatagcaggcatgcaataaacgtctactgactgaattacttaaaaaaaatcagatgcactaacactgagatcaaacaaccaaaaaagcagactagagtcaagccgtgaacattatacatgttcagaccccaaacataacaactgagatcttttttttcttttcttttcctttttttttttttttttgagatggagtctcgctctgtcacccaggctgtagcacagtggtgcaatcttggctcactgtaacctctgcctcctgggttcaagcaattctcctgcctcagcctacccagtagctgggattacaggcacccgccaccaagcctggctaatttttgtattttcagtagagacggggtttcaccatgttgcccaggctgctctcgatctcctgacctcagctgatctgcctgccgcagcctcccaaagtgcagggattacaggtgtgagccactgcacccggccagctgagatcttttgatctgacatctatgatcctgttatacagggggaaatcttagatccccacataaaattttacatttctaagctttataattcttataaaactatataaaatagtctgatttttcaggtatctcaaagcaaatatggatgaaatttgaaattggttaaaatgacaagcatggaagttagtcaccttatgttagaacaactgtctttgatacttagctatttagctgtgtgactcagaagaataacttaacttctctgaacttcagtgtcctaatctataaaatggctaaaacaagtatctaatagtattgatgtaaaattaaagagctaaaatagttgaagaacataacagtgtcaggtacacactaggtacccaataaacattagttataattattattgcttcaaaacaacgagtcctccttggttaatatactgcaaccacataactagacatcattttaccaggtattaggtttatttacttaggagaagtaattaacaatagcttgatacttaaaccataagatttattaataaaatctgtccacagtgtatgttcaggggtctctagttatttttttatggaaaagtgatgtttttaaaattgtggcaaaatacacacacgatgaaatttactccttaaaaaattcttaagggcacaattcagtggcattaaccataatgttgtgtgaccattttcagaactcctggtcattccaaacagaactctgtaccccaaaactatccattccccctctcctccagcacctggtaactgtcactctactgtctttccctatgaatttgcctattctaattatttcatataagtggaaccattcaatatttgtgcttttgggtctagcttatttctcttagcctaatgttttcaaggttcatccatgttgtggcatgtgtcagaatttcattacatttttaagctgtgtaatattgcatcgtatgtacaggctacaatttgtttatgcatttatctgttgatggacatttgtgttgtttccaccttttggctattttgaataatgctgctataaacattgttaagtatctgtttgagtccctgctttcaattctttttggtatatactgagaagttaaattgctagatcatacggtaattctatgtttaactgtgcaaggaatcacaaaacttttttacacagctgctgtgccattttacattcccaccagcaacctacatgagttccaacttctctatatcctggccaacacttgttactttccatcttttgtttgtttgtttgttttgtttttataatagtcactttagtgggtgtgaagtactatttcacggtggtttgatgtgtatttctctaatgatgagtaatgttgagtgtctttctatgggcttattggtcatttgtatatcttctttgaagaaatgtttattcaagccttttactcattttttaattgcttttttgttgttgttaagttacagaagttctttatatattccggatattaaccccttactagatgtataatttgcaaatattttctcctattctataggttatcttttcattaatttttctttttgtagagacagggtcttgctatgtttcccaggctggtctcaaactcctgacctcaagtgattctcccacctctgcctcccaaagtgctgtgattagaggcctgagccactgtgcctagcccatatttttactctcttgattgtgtcctttgatgcataaaaggtttttaattttgatgaggttcaatgtatctattttttcttttgttgcttgtgcttttgtgtcatatccaaaaaaattgttggcaaatccaatgtcatgaaagtttttctcctacatgttcttctaagagtttcatagctttagctcttacatttaggtctttgatccattttaagttttgcatatggtgtaaggtaagggtccaacttttaaattttgcatgggatatccagttttgttctaataattctggtacaatgtaggaaaatggctgaaaggaccatgtacaacttgtatatatctatagaggttaattaaaaatgcattcaaagtttcttttaaatagagaatataaaacaaaacaatatacctgttaccagatttttaagtaattaacttctaaatatctcacacaagaatttgagagaattggccaatatttaatctaaaccattatcatacaagatcttccccaaaggtcagaattcatgcaattctaccctcttaagaataatatctctacaaaaacattaaattggcttttatgttgttgtaatttagaaaaatccatttgtagcaaatataaacatatgagtcgattcctttagattataagtattttacagtgaagcaagtttattcttgttttactctttatggtgaatataatcgagatgattaagaatatagttctgctaataaacaaatttagtaaagttgcaggatacaaaatcagcatacaaaaatcagtagtatttcaatatactaacaacagagtatatgaaaaaaatccagaaaacaatctaattcacaataactacaaaaaggaataaatttgagcaaagagatgaaagatatgtacattgaattctataaaacattgataaaagaaattgaagacaacacaaataaatggaaatatatcctctgttcatggattggaagaattaatgttgtttaattaagttcatactaatgaaagtgatctactgattctatgcaatccctaccaaaattctaacagtattttttttcacagaaatagaaaaaacaatactaaaatttgtatgcaaccatgaaatactaaaatgtgtatggaacctcaaacagctagagcaatcttgagcaaagagaacaaagctgaaagcatcacactatctgatttcaaattctattacaaaggtatagtaatcaaaacagcagagttactggcatattgtcagattcacagaccaatagaagagaactgagagcctagaaacaaatacatacatttatggtcaactaattttcaacaaagatgccaagaatacataaggaggaaaaagagagtctcttcagtaagtggtgccagaaaaactggatattcacatgcagaagaatgaaattagacattcatattacactacatataaaaatcaactcaaaatagattaaagacttaaatgtaagatttaaaactgtaaaactactagaagaaaacacggggagaaagctccttgacataggtctgagcaatgaatttttaaatatgacacccaaaagatcagacaacaaaagcaaaaatagatgagattacatgaaacttaaaagcttctgctcaaaaaaggaaacaatcaacagagtgaagagacaacctagagaatgagagaatatatttgcaaaccatacatctgataataggttaatacgcaaaatatataagaaacaaacaactcaacagtaagaaaacaaataacctgattaaaaaatggacaaaggacctgaatagacatttgtcaacagcagacatacaaatggccaacaggtgtatgaaaaaatgttcaacataactaatcatcaggaaaatgcaaattaaggctacaataaaatatcacttcacacttgttagaacaactactatctaaaacacaaaagataagtggtgaggatgtggagaaaagggaaccctggtacactactggtgggaatgtaaattactacagccattatggaaaatagtgtgacagtgcctcaataatttaaaaaatagaactaccatataatccagtaattccactatggggtatatattcaaaggatataaaatcaatacgttgaagagatgtcttcactcccatactcactgcagcattaacaatagccaagaaatcaacctaagtgtccatcaacagatgtgtggataaagataatatggcatataaagacaatggaatactattcagcctttaaaaagaagggaatcttgttatttgtaaaaacatggatggccctagaggatattatgttaaaagaaaaaagccaggcacagaaagataaatactgcatgatctaacttataatgtgcagtttaaaaaagtcaaactcggctgggcgcggtggctcacgcctgtaatcccagcactttgggaggccgaggcgggtggatcacctgaggtcaggtgttcaagcctagcctggccaacatggcaaaaccccatctctactaaaaaataaaaaaattagctgggcatggtggtaagcacctgtaatcccagctactgaggaggctaaaaaatttgtctataactagctgtctatctgggagtctagttatctatctgtattatattctttcaatgtgagacacgagtttcataaatttaattaacagaatacagactgcactagagaagtgtgaaaaccaatttggagacaataaattcaattaactcaaacaacatactctcgaaaaacttcaagagccaacatcaatcttgtttatgtagagagacatgttgggcctaattcctgaaagattattttacttgaagatgggtaaaaccctgcaacatgaaaacagttttcataaaaaaaaaaaggaagtgtttcactatttgttattttaaaagaatagggttgtgctaaacttccagagttgacacattcttcctttctacaggataccttactaaaccagactaaactgtttaaatagaactcatttacataagaattgtgttgataaaaatgttgaggaaagggaaaagtacctagaaacatatcattagctgacaaggattgattgaccttcaatcattattttacattaaaagccctctgagactatttataagatttaaaaaatatggtaaaaagggcctaatctcatacacaggaaaggatgcttaaagtatttactggtggcaattttaatttggtacactggaatgaaatttttatttaaaaaaaaaaaccaaacacaaaggacatgaacagacacttctcaaaagaagacatacatgcagccaacaattatatgaaaaaaagctcaatatcactgatcaatagagaaatgcaaatcaaaaccacaatgagataccatctcacaccagtcagaatggctattattaaaaagtcaaaaaataacagatgctggggagattggggagaaagagaaacccttatgcgttgttggtggcagtgtaaattagttcaatcattgtggaaagcagtatggtgttttctcaaagagctaaaagcagaactaccattcgacccagcaaaagcaaatacatggaatcaacctaaatgcccatcaatgacagactggataaagaaaatgtggtacatatacaccacgaaatattatgcagccataaaaaaggacaagatcatgtcttttgtgggaacatggatggggctggaggttaccatccttagcaaactaacacaggaacagaaaactcaacaccacatattctcacttataagtgagagctaaaagatatgaacttatgaacacaaagaaggaaacaacagatactggggtctacttgaggaaggagggtgggaggaggaagcggagaagaaaaataactattgaggactggacttaatacattagtgatgtaatagcgtgtacaacgaatcccagtgacacgtgtttatctatgtaacaaaccttcaaatgtacccccaaacctaaaataaaaatggaaagaaaaactccaaacaacaaaacatgtgttttgtgtgtacacacatacatgcacatacacacacatacaatctctaagtcaccagattttatatcaagagctgggttgtttgttgtttgaggtaatcttttaaaaattaacttattcagaagctacaattatgttttgattttcctgagcattttagtactgatgctctccttttgggaacgaacatgacatgaaagtttttaaaaaatcatcaaccatttcttcgactaaactcagcccacatggcctactctggatattccaataaagcacactaggtctgttgacagaatctgcaggtgaagaggcaaggaaataccaaaaacgtgggtgcaacagttaattgaataatgaatccaagtataaccttcaggcattgtataataaggcaaccagaagcctccagataacaaataaagaggctttataaaactacttccatacattttccagtgcacaccttgaactgatgtaaattctcacttactatttcctccttccctcctacctaaaagaaagaaggcttcctccttgaagatcaaaggcttcatttccgatcttagtttgttcctgctcttcagagctttactcttcagttctccctgactcccccaccttttgcctgtgtttttactatctacttcttcactggcttcttctcatctgcccataagtgagagtctctcatcaatatccctgtctaccctcattctctctccacctattactctcttaccttttaactatcttcagtagatgtctcatggacattctgaaggcatttcagggtacgcaaaatatattcattttaatctacattcttatatcacaactcctacccgtgcaccaatcacgctaaatccttagctccactttcagttccgtactgtggcatccagtggtttaccaccttttgccacattctgtctccaaaatactcctggacctgatcccctcttcttcattccctatcccacagagttcagtgcttcaccgtgtctcacataaattactagacagcctcctaatcaatctcccaattcacctctcctttctacaaatatattcttcacattgctgccatggttattgttcaatgcagtgcaatcagggcatttctctgattaaaaatatatttgattccataaatagcatctaaataaattatgaggttttagagctcagaaaggactgttgaaataatctattttagcacagaatagtgggataatctttccaaggtcatcagtcacgaaggaaaagggctagtattagaacccaaaagcctgattcctcactgcatttaggcaaagcttatttccaagtttgagttttggtttacaaactgagatacttctttttcacttttaatgccatgcaatcattaaatgttcttttcaaccatatgtctacattataaggaagctgtgaagcaagataagcctcagctcttagttagattttgactaaagtgcttcactggacagatcttattgagaacaacatttttctctgttgacgtcagtggaaaaatgctaggcatatttgccaactctcagactctgttaaatgttacatatgtgttccaaatggctagagaacacataaatgaaaacattaatcccataggcagcagacagacactgtcactgctgaatttgagaactccaggaggtcttataagcccagttttaccagggtaagtcttcctttgtcagcagcatatggtgaaatcagttgaagaaaaaaaatgaacacagcatctgtgcactcacttcttcaagttttaacagccaattaggctttctacagtaatatttatagctccacaaaactcaggtagtaaatgtaatcacttttcccctctggagaatgtaggctgttaaactacagaagtgagggggtttattctactcatttgctgtcttaaggaacttaaaaagaagggtaattatttatttgaagattaccatccactccatggatagaaagacaatagaagaactaatattatgtgtctgtatgataaattgcagtgttttatgcaacaaaatgtaaaacaattaaagaaacacctcattcacttggtatcattagggacagggctattttcttaaattatttttcaaaataacaaaagctcctttgagctccaaaactttatttaattaattttgatggctacaacaaaatatactttaaatttctctgaattcttaaatatgcaaaatataattttcttaaagaccccggatcataattatgattatacaattctgtgttatgcagtttttggtgcttaagaactacagaggttagtagaaatatttggcccctcaccaagtcctgtcaaaccacaatgtttttgtagctctaatttctttgctgtgcttcatttaaaccctcagtcagtcagctctttattcttcttgttattgcaatcagtgtatctatgtctttgtcttttttggtctgtatttctcccctttaatttccagtttctaattgcctaaatgcttggacattagattataaaacctgttaaaatgcatgaaagcgatgtgttctgatgaagggcctgagagtctttgtggaataaagtgcatgagcctcagtgaatatatttgttggcaaatattttagttatgtaaagtttttttttgcttactgacttcctagtaagtaggaatttgaagcataaactatattgctattttttaaaagagaagcctcacatattttttataagtatcttctagctaaagttagaaaatactcggtcatcacttattaagctcttttaatatatatatttagacagaggttctccctcttgtcacccaggctggagtgcagtgacaagatcccatagctcactgcatcctcaaactccttgtctcaagcaatcctctcacctcagcctcctgaatagatgggactacagaaatgagctgccacgcctggcccctgaaaatattttttatttttgacattaaaaaacacataatagactgaaaatctacattcacagatctccgatgtttagtcccattaacttattggcacgtttgcttctaatctcctttaccaacccctcacctttttaaacagtcagaattactttaatgaaaataagatattctcagtatagagacttaaaacaatgaagaatagtataaaaatgaaagcaaaaagaagaaaaagctatcttaaatccaaaacagaaataatcatcaatattagaagatcaaatcagacagtaatctagaagagtgtgtgtgtgtgcatgtgcccacacacaagtacacagaagggtatacagacgatagaaacatacacattaaaaaaacaaactcgtatgattattaatcttaatttactgagcattaagtttaactcaatttaaaattaatagaaaaaacaaagtgaaccttaaaaatactttttaactgcagatgtatttctcagaagatcactttaaattttttttaaaagagaattttgaaaaaaaattaagaggctagaataatttgttaactacatgttttaatttagacggtaccaactgacatcctgccttcaacaaaagatgaagacattagcattctcatgcacccttctaattcccctccctcatttccctatttttgttaattataattgtgaaactgcctagatttatacattcacattctcttggttttcctaattcccagaattgtttagtattcatttcatttcaaagaggattaaatgctcatagccaatcgttttaccacaggtttttcattaataaattatttactttcattgatttgtattttgttttttgttagttctccttcccctccccccaggaagagtccaatgaattctttactttggggttttggttttcacatttgagaatttttactgctgtggttttcattagatagcatcttgctgcctggatgcgtaaagaattctttccataatcttaaaagtttatcagcttaactagaacatctctcagattcatgttctgattcaaaatttcctggaatatgttgtgttctttcgatatacagattcaatctttcttcattttgtaaaagttctcttgagttacatatgttgttccatattttgggttctctattcaggaacaccaattacccttatgttgaattagctttagctctgttccatagacattagattctctaaaactctccattctccccctccttcatccacatacactatactgatcataagtcttctcactgtcactaattacataatcagtactgtttatcaaatgccttgtattttgtctgttactagttcaataatgatgttagcttggccctcgatttgttttctcacacatacgatataccttttattttctaggctttgagctcactctttattgaatatgtgtccttagtgagtggttctttaatgtgacacaactgtgagattttctttggctcatttgtgttacagttttttcctttgggctcttcgtatactattttttttttttagatctaataagcttgtataattatttgcataaatgttgtgccatggcatatttttccccatgttccatgtgtttggacatttcagacaagactctgtatttgtcatgaaagagtgcacctgatttaagtctttcccttccataaataacatcatatgcttttccaccactatgagccacatatggaatgctaggagtttcacagtcctaccatccttctatagcttgaaagactgacaggaggaagatggttgcagaatctggctgagtattggtattgtgtttttgtcagaatacttgagctccactctaaaagtcgtttaaattagatgctttgtaccagggttcaacccacttcattgaagaaagatattctgttcccaaggaacagtatcttaatatttcggatcattttcccagcaatgaaatgtccattcaatcctgtcatagtcagcccctttgttcacatttccccctttattcaagtatcctgggactctgtttctaattcttgttggccagaagagaaaaagaaaaaggactcactaagaatgtctctctacatatttggttatttgtgagaattgtcaggattgggtcaactcagttgtatagctctagaattacagagtaggttaatgaccaagccacactgtgccactcactctgttccatctcggaattgtttgttttttatactggagacaagtttttcaagtgtattgctttaagttatccctcattccctattgggttcatatcagttcaaaatgaaaatgtttcagctagttttgctcgtttggtaggtatgggggaaagtgtgccattggattttatgttacagtttaaatatgatatcttaaaccagaaattttactcaagtttgtaaataagcagtttttcacagagctaaagagataactttaacaatacatagatgtagccaaagctctttcttctcatttcttcccctaaacacttgcaaattttaaaagtcatcgtaagattttaacagagaaggttaagagtaaaaaaatccacatctaatgcagtgaagagcaatttgcagaggcatgtcctgtcctttggcagaaaatagcattgagctactgtctgctaccattgctacacaatcaaattcttccataaaactgagtatatctgaagaatgacaaacaattaaaaaatatgctacaaaataaaaactcctttcttcaaaaaccaaagactatctcttaactttatagaataaatggaaaaaggcaaactgtacaaatcaggagacagcctgagttatatgtaccaatcacttacattatctgctctcctaacacggatataacaaaaggccagtttaaaaactatattccactgactgtttttggagactaagctatgcagaggaatttttctgtaagcagaaatggctagacaggtgctatattatagttgagtctttgctaaaattgttgcttctcatccaggtttggctgctccttctctctggaattacaacaccaattctcaaagtaacatgatgctcttccttttacttttccttaagcatgtttccccttagcatgtgatatggtttggatatttgttctcatcaaatctcatgttgaaatgtgacccctactgctgtagatggggcatagtgggaggtgtttgggtcatgggggtggatccctcataaatggcttggtgccctctgcccactgccctgccacaacagtgactgagttctcactctattagttcataaaatagctgattgttaaaagaccctggtacttcttcccctctctcttgctccctctcttgccatgtgacactgcctgctctcccttcaccttccactatgattggaagcttcctgaatccctcaccagaagcagatgccagcactatgcttcttgtacagtctacaaaactatgagccaaaataaaccttttttctttataaattatccggcctcagatattcctttacagcaatgcaaaacagactaacccagcatgcttgaaagagcctgacattttaaaacagagaactttattaaaaaccagaaaaagaattcttgaaatatttactgaaaatacagccactgtttgaaaaagtcagctttccaaatacaggtttcccatcccaagacttccagttgacagtacagaagagtttttcttcaaccaacagttccatgtcctacccacatgtaaggccaaatttggcctgcatggctacttacataactatgtggtttcctttcctcctaggtcccagattttacaatgaaagatactatctcattttttctaaacaaaagtgtaatccctcatttattttattctattttaaaaccaaataccatgaccttattaatgaagctctttcaaactctgacatacttaaccaattaaaaaggcaagagaaaatgacatgtttgatgtgcatgaataacttaacactcctcagttggttcattaacttttgggatattctgttatgccacagttgctgagtgttctcaaatacatagtttatactctcacatgaacataaacagaaatggtttttcatattgtattcattaaagtgctacaatatatcaaccttttaaatatagcacaatgataatgttacacatttagtattgatttagtactgattcagtaagatgtaccacattttcttaaccgtagatataactgtctctctagttagaaaagatattcagaaaactaactaaaatccaacaattaccttatgattacttccttagctgtaaaacatacatacttcttgttgcatatactctttgttgtgattaagagatcagactcagaagtaggtctgtttggtatcaaattcaggtgtaaaaacttactaccatagagctacaggtatctatcttaactcatgaaggcttattatctgtaaaatcatgataataatggcaactacttcataagattatcaggattaaatgaaataatgtattcagggctctgagtgcaatgaataccacatatttaagcacttaattcaagttggctataattatttttaaaagctatactatagtattcagaagaagtgacctttctgtttttttaaatatatcagtcatcagaaatggaatgtggggtagggtggggggagggagaatattagaaaaaatagctaatgcatgctgggcttaatacctaggtgatgggttgataggtgcagcaaaccactatggtacacgtccacctatgtaacaaacttgcacatcctgcacatgtgccccagcactaaaaataaaaacaaaaataaaaatgcagtgtgaaagtagaggtaaaataattttctcacaaacagaataattttattaatataaggaggtagaatcaataattgttattctatttgaccttttctatacctaaataactgagaaggaagaaaaaaagaaagactggctgggtgcggtggctcacacctgtaatcccagcactttgggaggccgaggcgggtggatcacctgaggtcaggagttcgagaccagcctgaccaacatggagaaagcgtgtctctactaaaaatacaaaattagccaagtgtggtggcacatgcctctaatcccagctacgtgggaggctgaggcaggagattcacttgaacccgggaggcggaggttgcggtgagccaagatcttcccattgcactccagcctggccaatgagagcaaaactttctcataaaaaaaaaaaaaaaaaaaagaaaagaaaagaaaagaaaaagaccaggctatgtgttaacttagtccttagaaggtatttgattttttttttctttaaaaggtctgaaattttcaggtgaaaactgagctcacagaaataacccagacttccgtaagattatgttcttccttcccactactacagccttctactccttctactttaggaattaaagtggtggtgctagcaaaacattgatatttgcctgtgatttgggattaagaacattaaatgtcattgggtaattttcctgtcttttcatgaaaactagaactcacaccagctatattaagtaaaagtagatctgtaggggaaagtcagataattcaattataagttcagctaggcctctgggaaactagaatatcatcaaggtactatgctcatctccctttccatgacgagaaagggacgctggctcaatgattctctgtctgcctgctcaattctccttccttctgattggcttcttttgcataactcatttttgcagctcctcataactctcacttaaccatggcttttggagagcatattttgactctggccgcaaatctccaagactttagaattttggtctgtcttggtttcacatccaggttgaccagttagatgtttacatttgatccaataaattgtctaggtcagaatcatgtgacatgtagggtggcccacccacatagggtgtgcgtaggatttattctccatgaataggataggggtaggaaggaaatttatatataaaccataagacaaataaaagcatttaaatctaggacacacgtttctatttagcagagctgtctctttaacctgaatttattgaggtacaatttacatatagcaaaatccactctttttggtgtatagttctgagtttcgacaaacacatatcgtcgtgtaaccatcatgtgatcaagtcaaagtatgtttctatcattaactcatatctaaaaattctgaaaaatgtacaccttaagtatccctccttttaccttaaagaagcgagctgataagctgctcttactgaggaactttcctttttaaaaaatttgcctttaagaggtaacagaaacattatatatattgatactgagacctgagtatttttactcatggcctatttcaggctgttatttaaataaatattaaagggacttctttaagctagaacttcatgaaacatgtaatgtataagggctcaggtgaagcatctctgtacagtatatacagtagacacttattgttataagctttagacagtatctgaatttagaccacagcttgccgataaatggacactctcccatggcattctgccagtggaggggtggaaatgcttgggagataaacaaaggtcacagctttatttaacaccgtcacacaccaaatcggaagataggcattccctattggggcagagacagtctgtcctcccgtgactgctcagctcttcagtggagtcaaatcctgcctttaaaaggtggggctcaccaagtggcctaaaacaggtctcatctttcatcaagggcttctaattttaaattgctgccatgctaaattttatcttgagtgttgccctcagtctccacccagtttgctgagatgtaccactggttttaaacaagaattttccagggttttgaattccaatgtgcattatttagcaaatacccttcatagggcacaaaaaatgcaagttgattaagaatttgaataaaagcctcatttatgagcattggatgtatttcatgtggtatactgaagctaacctacaaaaatatcaatctctactgataccgctctctgcaataacagaatccactaagaagagattaaaaacaaaaccaatcatttcccaggataaaaggttaaagttccaatttaaacaatacttagaaatacactgtagcagccttatgagttgcaacttggactcaactggtaaaaatgggtaattatcacatgctatgaaactcaactcctccaaaatacgagggagcaggattcctctggataactttgcccagaaacaacatatctctagtaatgctgccagcaggaaaatttagctgataattgctgtttaaagcacttatggtttgaaatgggaccccttaaaaataaaatttctagtttaacttatatacagttacccttataaaagacaagggtacagatagaatgtacttactgaagttatttaattctttcatattacacacacatgtaatttttttttctgttatggaattcagcatctttcatgtagattaacatcacctgcatgtgcattttattcccattgtggactaaggtactagtgtctcagtgttcagtgcagacagattgaaatgcctgagtgaaggccaccatgtactgcagcctttagtctgcctttacagatcagaaaaacctaaaccagtcttccataaagcttaatcattggctggggtatggagaaatctgattcttgcatttacattataaaaccccaacataatataagactatgcctgggtatctcaagttatttctagcagtctttccattgtcagtaaaaggtgtttcttatctacagaatgtgggccaagagtcactgcactgagtggacgtgaattctgggatctcatgttttcagcattaggattaggttgtacaagaacctatggggagtagaatgtgggagatggagattgacctcaaagtgtgagagctcttggggtgattaccataagcaaaaataaaaaagggataattaagtgagtccaaacggtttcaaagcccgaaggctgtgtgagttgtagaatgtgaagcatgggagctggagatgttcctgagcttctctcttcaccccgatgatgaggagagaaaacacaggacagccaggccttcttggtttatgcaggaagaagagaggtttcttggaaggctttggggtagctcacaaaacaaaaggtaggcctgaggaagcaggctcagcaatcatgaaccagagaggcttcctggtttcaggtggtgggaacagatgtgtctctccaccagtcagttcacttctattttcagtccgtaagttatttggctcaggttacaaattccagagaagggggtgtacctcacaagcttagttcaggttttatgctcaccccttagataagggagaaaaagatagctggggcagacccagcaggctacatataatgaggaaatgttggtcttgcagttaaattgtggtggtttccaaaagaacacaatagctaagcaacaaaaataaaagatattaatgatgcctatcttttatcttaagaaaaaaaaagttttctggttctttacgtatttctgcctaaagacccattaaaaactgaagggctcactcatattcacagatccctgctgaagctgggaaccagagggctgagtcactctcccctgctgtttatccgggtcccacaccagcttgctgtcctttctcatcatctcactttgggccaaatgtaactagagacttctcagcttatttttagtagctggtagagaaacataatgtgttcaattccttaattaatagtctccacaatttttccactagaggagaggagacaaaacaggttaacatatttatctctgtgcattaaattatctataggtaaaataagaccaggtatcatttgaatttcaaattcaggcaagagtaattgattaattaattaacaaaaaagacaatatttcatataatcaacgtgaggaatttcagatttgcagttgaacctctaaagtgatttttttccctagacttcactcgttgtccttccccagcctcatgtgtgtgcacggacacaaacatacatacatacacacatatacatgtgtgtatatatgcacacacatatttgtatacacatgtattttgtatacacagggtaattcacagatgttatctgatttcataaaattgtgtgtgctactttatacatctttatcctttttaaccttttgaatcagaaaggcatatggtcagaggaaaactcagtttctctgataatgactgaattaaatatgcaatcttacagtgtagattagtatacagtatagtatagattagtatatagtatagattagtatatatatagtataggttagtgtatatatagattagtatatcatatagtatagatagtatatagtacagtatatagtatagtatagattagtatatagaactttgtgccaaaaaataaaagcactttttaaaaatgcagttccagttttgtaaagataacttaagtattgcatccagtattaaactggaagtaattgtgtttaagaaaagagctttaattggcatgtatatgccttgttgctattcacctagactacccacttttggccacattgtttcctttccttcaaaggaaattttgctcctggcttgaatcctggctgcctcttctttctgtctgactgtagtggacctatgcggttttttaatttgttttttgtttcactttttttgctttagtaaactactctcctactcttggtccatgtgtcctgtactggtttgacaaccacctgtttccagctccacaagctagcatgtaattcccttggtgagagtaattggttcaaggatgaactatacaactcaattttcatagagttgttggaattaactggcaaaaggctatctttgcaataacacttgttgctgtaagaatgatgtaagcctggaactgctggaggtcaccatattggataaatgtgcctggcaataaagtagaaaagaggacctgagaccagctgaatttgggccaccattgagcaacatttgaaaccaggtcaactcacagatttttctcaattatttgaggaaataagttaactttttggccaaagctattttggattgctgccccttgcaatataaagagtcctgaagaatgcactaatttttacatgttattgtcaaccacttttcagcaaaacacccccaaatcaatccatgtgattctagctacaaaggttttgttcacacttcttttctcaatagaacaacctaggttgtgaggctcagctcaattctgttactaaaacaccttctgatcatgctttggtccaaatagaaccagctctcacaaacctaggctttatctctttatttaagaaacaaacccactccagtactactgattgagagcttataacatccagaagcttacagaaaagcctctatctatgaatattcgctggttatagtaataaagagacaaaattggtggtccgttagctccatgttcagggcatgcaggtaaaagaacagggtcatggaacaaggaagggatacaaaaaacagtttgaataaaaaataagacttcagaaagtctcttgttaacttttgttttaaggaaagagataaaaacaaaccattcaaaactaaatgcaagcacataataccccatcatctaagttctgctaaagagtaaatataaagcaatattttacagttgttcatagcactattttcagtgtcaggcaaatctaagtttaaatcctagcacagccacttactctgtgaccttaggtaaagcaaataaactctcctccctcaatttcatctgtaaagaagaattagaataatactatataccttatggagttactgtcaatgagacaatgtgtatatgcttgtcagtttgagaaggaggagttcatggtaagtgcttaacaaatgttcactcttattaaggccagacattcttttacaaaatcaaaatgactttcaagtaatttcacatgctgataaaggcaattcagtaacatgcgcctgaggcaaatttcatttgtgactatggctttttactcttaggtcttattcacatagttaggtttttcagcagagacaacatcccagtctctaaaactctctttcacaccgtaacactcaaaaggaagagcagggtctttattcttaattattttttgctttctttaggaagagattatctgaacaactaaagagaactgaaggattgaggttgctttgagaaatagtttcattgagaaatagttaatattgaaacacaaagttacagaaacaatgctttaaatctaagtgtatatggaaagtgttcttccttctccagactattagtaacagtcagttataaagtttttccaaactctgggcctaaattttaaaggtctaaatattgcaattcctatggcatgaggctgtctatcatcagtacacgctagtcatagtccccaagtgttttgggtttcacaattatcagctaagcatacccttcgaaaaagtctgtatcatcaataatactaggaaaagaagccaaatatgatgatgatgtcatccagatcagtaggtttctttgttcaagcaagagcaggcagaaaatatttctttctgcccatgaaaatgccccatttgggtcaacatttctggaaagggttgaatagttttcagattccaaaataagagattaaaaaagcaaacaaaagagtctttctttccagagactccattgaagaatgcaaccactgagaaaatatattaatccatgtatatacgttgcatgtttcagtcttggcaccttgtgggtttgagaaagaaaatgacaggaaagacttcaattgcttaaataattatagccattagtatcaggctccccgggtaattgaatatcctactttacttgctggctaaaaataagtagccaaatgtttctaagaaaaagacaaggtaaatggtacatactgatacttcaaatcattaagcatcataataataaagaaaaatcatatttcaatttaagtacatcataaataccatgtgagacaacactgcctctatttagaccatacaggcataactattttcatttcttaaaacgtatcatgatgtctcattttgctcaaaagcagatacttggctaaaccaaatctctagttttagtactgaccaaaaatcaatttctatgattctgagcatactaattaactattacttaggcaatagttggcactgaggcaccattatgtaaccaaagtagcaagtagatgaaagaaaacctaaaacattcacttacaactctttaaaccctttgcaaaacaatgctatattcttcccagaagttttctcatgtgctcttctgcaaaagtatttattgaacatctgttatgtgctctagacactggggataatagtgatcaaaagagaaaaaagtccctgcactaatggagcttacgtcatagttggtaatatagaaaattaaccagataaattaattcatggtagtttaatagtggtgtcaaaaaagaaaaaaaaaaaaagccaaggaaggaattaagaaaagttggtgaagaaagcagatcaacttttagattggtgggcagggaaggcctctgtgagccaagctctgagaggagagctggggagaccatgcaggtttctgggagaggaacactcagggccaaggaaagaggaagtgcaaataccttgagctgcaatatgcctagcatgtcccaggctgtgaggtaggcagtgtggctggggctgagtgggtcagaaggagagcagtaggcaatgtggcaatggagtgttttgagcagaggagtggcatgctcttggaatttgataggaactctctggctactgtgttgagagaagactatatgaaggtgagggtagaaagaggaaaactagttgggacacttttacagtgatccagcaagcgatgataatggttttggccaagggggtgctgtggagattcaagatatattcaagttctgacagattcaagttctgaatatattagattcaagaagtgcaaatgtcttgaagttgagatatgcctagcatgcaccaggctatgagtaaggcagtatggctggagcggagtgaaatatattcagtttctgaatgtattttgaatctaataggagttgctgatgagtcaaatatggtaagtaagagaagggcgcaatgagtcaataattactctaaggtttttggactgtgagcctgaaaaagacggagttgccactaagaggagtaactttgaccttagagagatgaggagaactgttttagatatcttaaatttgagatgccaattagacatgcaagtagagatagtgagtaggcaacagaatgcgcaagtctggagtttgggtagaggtctgagtagcagttgtaaatttggatatcattagcttatagatggaataatttaaagccatgatactggatgagattcttaagaagcaagtataagcagagaatgcatgatgcccaaggaccaagcccttgtactcctacgtttaaatgtctgggagatgaggaagaacccgcaaagaagatacaaaagggtggaaggaaattacctctatggtatggccaaattacctctatgatattttgaatatatgcatgttaataaggttaaatgaatattcaaaagacttaaaatatcttgaagagaggcacaaaatcctactcattttgggcttcagggaccagcactgtaccagctacataaaaaaacactaaatgtatctgttgaatgaataagtgaatggataaatgaatgtagaatcttaaacattcactttggctcaatgaatatttattgagcattttctagttccagaaactgagcaagacactgagaaaacaaatatagatagagatctatctgatagggaagacagacaggttaacttgatagtatattggtttaatttcttgctaagagaaacatcaggcaattaaatggaaatatatcagacacagaagaaaaaagtatgttatttaggagaatgacagaactcctttaaagaaaattctaaaatctgattccccatcctcccttttaacaagaaatataagaaattacagtgaaagtcaatggataatcatgattcaagatagtcaatttcctatgcataaaacttttcattaacacgtctatcactacacgagaacagcaaagaagaaagatgaacaagatcataaattataattttcttccagttctactttgaaagctttttttgaggctccaataaaagttctggttaattttagattactaatttgtaattcaaaacttataaacttcaaaagcatttatgaaaaatctaattaatatttctctttcatatattctttaaaacaaaagtaacatcttacttaaaataactgggacagaataactctactcagttagatctttgccctcactacctcacagaactgacacatatcacacaatatgactgtatattaggtaaaatacatgtatacatcaagaatgaatatattaaatttcagctgatgtatgctcaataattgcttctactttttgacttatttaaaatgtgaaataataagtcaacattaaacaactaataagtcaacaattcaacagatgtttgttgagtgcctggtatgttttagtgctgtttacatccttgctttagttagtaaagggaaggaaggtcttctctcaaaatctgcttgtttgtcaagtcacatagcttcctgggacctattgccattatctttcctattttagaagttttacttattttattcacgtagtcaaaattcaaaaaaaaaaagggaataagtacctatttctgagtctgctaaatgtctattaacacaatgtcattgcattaactgttgtcaatgacacagctatcagctagtcaaaccatcatgagagataaaatcttcttttctctaatcagattattgtagttatttagaaatgaaatgttctaaatagaaggcttcaatagaagaggttcagatccaattaatcatcatatctattacttttacccctttaattactctctaaactttccacttttattcgctcccactgcattgctcagttccaaaaactagcatctctcactaggatgccaatgttctccaacttgtagctagaatgatttctctaaatgtgtatctcatcaggtcactccccttaactctattttaaaaaatcaggatcacattttaatgcaaggatggtaaaactggaagttgctttggaaattgctcccagctggtttcttcagttctcagagccttaccgtgctctcctttcacccttaaatgtaatagctcatccacactaacctctacatttctacaattttccacgtctgtcccctctgggcctttgcacatgttgttcttcttggcattgcagggaggagctagaatctgtgactaagtaaattctactcaatgtagagtcttctgtgtcttcccattccccagctcattagacaccatttccttctgggagctcaccttgtcttagggctcaccacagtttatggtttcttgtctctactaggttgtaagctctttgtaggcagatatgtcttattcatgggtttacctctagtacttagcaaagttctttgcatataattagtacttaataagtattcattgaatgaatgtattataatagcaaatctatttacagagaatgtctaaagtaccaaagctgaggggggttggtggttgtggttaactgcaagccgacagcagaacctgccaagtttgggtgtctcaagtagaagtgaaaagtaagcagggattaagtgggagttgggcttcctgtctgcaaagtccaggctgggagatgaaatggatgagtgcatggcagaaaatatcatcacatactgaagaagctgactgctaaacttagcctaacatgttttaaattgtaacttttccagattctctttcatagcagaatgtcactgacagtccacagatattgtctccaaaatggcaattaatactgaatacagcaattctagcctctttcaaggagaaccatctgacccagaagctgaaaagaatttacttaagaaggcaccaatttaataagcatccatgattttacatttaattaactttttgagaaaattgtgctttcaaaatctagttaaacaaaagaggtagtaaatctctttaatgcctcaacatcaaattccaatggagtatgattttttttaaagtttcagatttttttttctgagaaatatcaaactgcttttattatccgtctcggcaacctataatatataagaaacagatcaaactaataatcttaaacatgtcttaaaaatgtaaatttctagtcttgatttctgacctccagctaatgaattattatgccttgcttgtattttcaaatccaaaccatttagtagtttataactggatttttataaaatttgacattttatttatttatttatttaagacagagtctcttgctctacccaggctggagtgcagtggcatgatctcagtttactgcagcctctgcctcccgggttccagtgattctcctgcctcagcctcccaagtagctgggattacaggtgtgtgccaccatgcctggcaaatttttgtatttttaatagagattgggtttcgccatcttggccaggctggtctccaactcctggcctcaagtgatctgcctaccctggcctcccaaagtgctgggattacaggtataagccactgtgcccagcctaaatttaacattttaaataaagcattatgaggacttttggtttccggtatggtgtgtaaggagcttaaaagtccatcactctgtaattagaacaagtaaaatactgaacaaactgacaaattaacactcttcttagatctgccatagaagtgagtttacagtgcaaactgctgcccctaaaattggagagtaagacaggttaggatagagtgtcacaatttatcagagcagaaatccacgagcagaaacctcctctgaaccatcatgaggtaggaaaacataaacttttaactgatgaattgctgaaggatcagtgtggacaagtctgaaagataaaaactttagggggacctaatcttaaggggatcctcacacttctgtgagttttacttccaagagttgtatcagagcttcacagtgaataccagaggaaaaatctctttctgcttctggaagaaggaggagaaaagaaacaactttgaaatatggcagagaatgctgtttgtcttaacaaggtctgccctcaggaacaactactttagtagagcccaacctgctggggttttatcagagtctaacaaacctagggaaatagaaatccccaattctacccagctgtacccttaagcaccagtgtagatcacagtctagaggtacaggcttatgaaaagactgagatctaaatataggactacagaatgcttcctctttccccataacttaccactattattattgaaggcttatttaccagagttgtgcttttttttttcctaacctagtgtattagtccattctcacattgctataaagaaaaacctgagactgagtaatttatagcaagcttaactggctcttcttcaggctgcacaggaagtatggcagcatttgcttctggggagacctcagggagcttttactcatggcagaaagcaaagcagcaacaggcacttcacatgctgaaagcaggaacaagagagagaaggaggaaggccacacacatttaaatgaacagatctcaggagaactcactccttatcacgaggacagtaccaagaggatggtgctaaaccattcgtgagaaatccaaccccatgatcgaatcacctcccagcaggccccacctccaacactggggattacaattcaacatgagatctggtggggacacagatccaaaccatatcacctagtacatcatgcccacctttcaataaataacaaggcatactaaagggcaaaaacacagtttgaagagactgaaaaagtttcagaaccagagtcaaatatgacaaatatgtgggaatgatcagaccagacattttttaaaactgtgaatcatatatgaagggctttaatggaaaaaataagatgccatgcaagaacaggtggatgatgtaaacagagagatgaatattctaagaaagaatccaatagaaatgctagcttgaccatcaaaagcactataccagaaaaatggagaatgtctttgataggctcattagtagactagacagggctgagaaaagaatctctaagcctgaagatatgacaatagaaaaaacttctaaaactgaagagcaaaggaagaaaaagactgataaaaaagaaagcaaagaatatccaagacaacttagattgtgggacgatgacaaaaagtgtaaatatgtgtaatttgtgtaatgggaatagtggaaggagaagaaagagagaaagaaatagtaacaacatttgaagcaataatgactgataacttcctgaataattattgtgagacagcaataacagtttgacagtttcctcagatccaggaaactcagagaacacaaggtatgataaatactaaaaaacaatccctaggcataccacattcaaacatcagaaaaacaaagaaaaagaaaaaacaaagaaaaaatctttacaaagattctcagaaactaggcaagaagaagagtgtggaatgaaacaaagtgttaagaagaaaacaaaaccaaaaaaccctagaattctatattctgtgagattatccttcaaatgtgagaaaataaatactttctcagacaaacaaaaagaaactgtagacctgtcttgcaagaaatgtttaaaacaaagttttcaggagaagaaaaattacaaagattggaaactcagatctacagccagaaagagaatcaaagaaggaataagtgaagacaataaaaactatttttcatattctaaattgatctaataggtaacagtttgtccaaagtaataatagcaacaatttattcaattatgtatgcttgtgtgtgtgtgtgtgtgtgtgtgtgtgtgtgtgtacttatgtataagtgaaataaataacagcagtgatacaagggacaggagagaagactaacattttgttattataagataccgatactacccatgaagtagtataggagatattgtgggttcagttccacaccaccacaataaagcaaatattacaataaaatgagtcacagctttatttcacagtgcatatgaagttatgtttgcactataccatggtctattaaatgtgcaatagcgttatctctaaaaacaatgtgacatatcataattttaaaatactttactgctaaatacgctaatgatcatctaagactttagtgagctgtaacctttttactggtggaggttctcgcctcagtgttgatggtgctgactgatggggtggtggctgctgaaagctagggtggctgtcgtaggttcttaaaataaggcaacaattaagtttgctgcatattgattgactttttttcaggaagtttctctgtagcatgtgatgctgtttgatagcattttacccataggagaacttctttcaaaattggagtcaatcctctcaaaccctgctgctgtgttatcaattaactttatgtaatattctaaatcctttgttgtcattcaacaatgttcacagtattttcactaggagtagattccatctcaagataccactttatttgctcattcataagaagcaactcctcattcatggaagttttatgctgagattacatcaatgcagtcacatctgcagattacacttccagttatagtcttcatgctattttcacatctgcagttatatcttccactggaagcttcaaacatctcaaaatcatccatgagagatggaatcaacttcttccaaactcctgttaatgttgttatttttacctcctgccatgaataagtaatgttcttaaatggcatctagaatggtaaatcctttccagaaggctgtcaatttactttgctcagatcaatcagaggaatgactatctaaggcagctatcgccttacaaaatgtgttaataataatacttaaaagataatatgactcattgacccagaggttgcagaatggatgttgggttcgtaggcatgaaaacaacaatcatctctttgtacatctccgtcagagctcttgggcaactaggtcaattgtcggtgtgcagtaatatttgaaagaaatcatttttcttcccccccaggcagtagatctcaatgccaggcttaaaatattcagtaaaccatgatgtaaacagatgtgctgtcgtctcggctttgttgttatatttattgagtacaggcagagtagatttagcatctatcttaagggtcctagaatttttttttttttttttgagatggagcctcgctctgtcgcctaggctggagtgcagtggcatgatctcagctcactgcaatctcagcctcccgggttcacgccattctcctgcctcagcctcctgagtagctggcattacaggtgctcaccaccaggctggctaatttgttgtatttttagtagagacggggtttcaccgtgttagccaggatggtctccatctcctgacctggtgatctgcccatctcggcctcccaaagtgctgggattacaggcatgagccaccgcgcctggccgggtcctaaaatttttggaatggtcaatgagcattcatgtcttcttaaagtcatcatatgcattaatccctcatgagaaagttaacctgttcttgaaagctgtcctttaaaacttcttgtctcaagctatgaaagtcccagatggcatcttcctccaatagaagattgttccatctacattgaaaatctgtttttagtgcacaaaccttcatcacttatcttagctagatcttctggataagttactgcagcttctccatcagctcttgctgcttcacactgcgcttttttgttatggacatggcttccttccttaaacctcaagaaacaacctctgctagctttcctctattcttctgcagctttctcacccctctcagccttcaaacaattgaagaaagttagggctttgttctggattaggctttggcttaaggaaatgttataactggtttgatcacctatatggaccaataaagctttctccatattagcaataaggctgttttgctgtcttatcatctgtttgctaaatggaatagcacttgcaatttccttcaagaacttttcctttgcattcacaactcagctaactggcgcacaggtctagctttcagcatatctctgcttttgatatcccttcctcactaaccttaattctttctaggttttgatttaaaatgagagatgtgtgactcttcctttcacttgagcacttagaggccagtgaaaagttatttattggtttaatttcaatatctttgtgtctcagggaataggaaggcctgaggaaagggaaagaatgggggaatggccagtcagtgggggcagtcagaacacacacaacttttctacagattcaatgaaatcccaatcaaaatctcagcaagttattttttgatatatactaaccaattttaaagttcatatgaaaagaaaaaagacccagaatagccaagagaatattgatggaaaagaacaaagatagaagactgacactactcaacattgagacttaccataaagctacagcaatcagacactgtgctattggcaaaagaacaaacaaagagatcaacggtacagaacagatctttgagtatagaaatacactctcataagtacaatcaactgatctttgataaaagagcaaaggcaatacactggaaaaaacattctttaataaatggtgctgaaacaactgaaaactcacattaaaaaaaaatgaatgcagacacagaccttacacctttccccaaaactaactcaaaatagatcacacacctatgttttatgtaaaacacaaaactctaaaacttcccagaaaacaaaggagaatatttagatgatcttgggtatgctgatgactttttagatataagaccaaacacataatccatgaaagaaacaaattgataagcttaaaaacttaaacttaaaaacttccactctgcaaatgacactgttgagaggataagaaaagctgcagactgaaagaaaatatatccaaaacacacaccggataaagcttctgttatccaaaatatacaaataactcttttttgtccatttgtttgttttgagatggagtgtcactctgtcacccaggctggagtataatggcttgcagtatcttggctcactgcaacctctgcctcctaggttcaagcctctcaagtagctgggattacaagcatgcaccaccatgcccagctaatttttgtctttttagtagagatggggtttcatcatgttggccaggctggtctcaaattcttgactcaagtgatctgcctgcctcagcctcttgaagtgctaggaatatacaaatcaccctcaaagcttaacatgaaaatgaacaatctaataaaaaaatggatgaaaaacctgaagagatacctcaccatagaagaatgcagatggtaagcgagcatatgagatgatgttaatcattgtatgtcattaggaaatttcaaattgtaacaatggaatatcactacacacctattaaaaaggccaatatcaagaacactgacaacaccaaatgctggtgagaattcttacaaaggtaaagctatggagacagtatggagcaacaggaactctcattcattgctggtgtgaatgcaaaatggtatagccacttaagaatactggcagtgttttagaaaactaaatatacacttacaacatgattcatcagcagcacatttaggtatttacccaaatgagttgaaaacttatgtccatgcaaaaacctatatatggatgtttatagcagctttattcataattgccaaaatttgaaagcagtcaaggtgtctttcattgggtaagtcaataaactctggtacgtccagacaatgaaatattattcaacgacaaaaggaaataagctataaggccataaaaaataaatagaagaaatctaaatatgtacagttgattcttgaacaacatgaggggtagagtatcaaccccccaacagttgaaaacccttgtataacttttgattccccacaaatttaactactaatagcctactgttgactggaagcctgaaggataacagagttgattaacacatattttgtatgttacgtgtattatatactgtattcttaaaataaagtaagttagagagaagaaaatgttactaagaaaatcctaaggaagagataataaatttacactcattaagtgaaagtgggtcatcataaaggtcttatcctcatcatcttcacattgagaagactgaagaggaggaggaggaagaggaggaggaggaagaggagaagttggtcttgctgtctcaggaatggcaaaggtggaggaaaatccacgtataagtggacctgtgcagttcaaacccatgttgtcccagggctgactttattactaagtgaaagaaatcaatctaaaaggttatatactgtatgattctaactatatgatattctggaaaaggtaaagctatggagacagtaaaagattagtggttgccagaagttgggggtaaggaggacagaacaggcagaagacagaagatttttagggcaatgcaactattctgtatgatcctacaattgtggttacagaacgtcacacatttttaaaaacccatacaatgtaaaacaccaagagtgaaccctagcataaattatggactctaggtgataatcatgtaccaaagtaggtttatacagtagtacaatgtactattataactaatgtactaatgttgtatggggattttgatagtgtaggaggtggtaaacttgtagagataagggtatatggaaactttctgtatttccactcatttttgctgtaaacttaaaactgatctaaaatataaagtttattagaagtttaaaaagaattgtcaaagtttcaaaaaatcctatagtccacaatattttatctaacttcatgaagatgaattataataaatatgggaggtgatataacaccaagaaatccagatctgtattaaaaagggcaataataataataattaccatttttattttaaattgagacagggtctcgctctgtcaactaggaagcagtggcataatcttgtctcactgcagccttgatgaaccgggctcaagtgatcctctcacctcagcctctcaagtagctgggactacaggtgcataccaccacaccagctactttgtaaaaatgtttttgtagagatgaggtctcactatgttgcccaggctgatctttaagtcctaggcttaagcaatcctccttccccggcctcctgaagtgctgaggttacaagcatgagccacagaattaatgtgatggtatagatatgttaagaagaaatccttattctcatcaaagaataaaaattactaaagcaaagaaacaaaatagaaataggccctctggaatttatgacaattatccctgaaaaaaattctgatatcaaatagtatttatcacgaagaacctacctccttctgtaggttgtaactaaagagtctttaggagacaagtttatatcttatcccacacaaactgaaagttttcacgaacataaaggaaacatgatacgtgggtagaaggatttaatttgccactgtggagcaccataatagagagaagttaatcgtgtattttgccttccactcagaatagaatcaaaagtatatgacaaagcatccctttctattaaaaggacagaatgtcatgagcatttaaagtgttcttccttaaaaaatataacaaaatcattaattgttttattaatttttcaataaaaggaacacgatccggatatgccctttcatgaggaaaaaaaaaaccactaaaattgttagtatacgtactggaaaaccagtatttttcccacatgagacatactaaaattctagattcattggttttcactataatgaacattaaatttcattttaaaatagcccagatgttttgattcaaacaaaattccattttctaaaaacaaacaagaaatttagtatagttatagcatcagggtttgctatttaaaatataatgcattttatgtagattaactgtttattctttttttttttttttttttttttttttcattttttaagtcaggttcttgctctgtcacctagagtgcagtggcgtgatcacagctcactgcagcctggaacttctgggctcaagtgattttccgcctcagccaccctagcagctaggactacatgcaagtgccatcaccacagactgatttttaaaacttttttgtagacaaagagtcttgctatgttgcccaggctggtctcgaactcctgggcttaagcgatctcctgtctcagcctcccaaagcacttgtgattagaggtgtggaccactgtgcccagcctccttcttaaatacaaatgatgatcttgaaacaaaatttgtagactcagctatgttctataaagtattttcaaagggattacactattttagttctttttttttttatttctcccaacaccttacttcagtgacttctaactgggctaagctatctctaaactaagtccatttttgcttgaagctgtctacacagaacaatatcgtggcaaacgttgtattgtactgtaattactaattttttttttggtctcttgaacaagtattcactcaacaaacacataatacggattttctctgacatacagttcctgaaataaatgtcattaatgaagggtaacaaaatatgtcactccaaagtatgccacttgtaaaaattattttttgctgaaggcaattgtgaagaagcagatacagataaagctctttgctttccctctgtctgcctaaaagcatgacataaatttgtagagttttctctcctgccctctctccagggaaggcagaagttagtgacaacctagagcctgagcctggagactgcaccagaggaatccgcataagaaactttactacaaccagccattatctgccattaattatcctcatctatttaccttcatacaatttgctgttcctatagactcaaagtcctcttcctttgttttgtctcttctctaagaatttattgttcttttaagatgatatataagctgaagttctaaccacccttttgagttactcatctctgagtgcttccatgtgaacgtattatacacagtttaataaacgtctgtttgtttgttttttccttaatctttctcctgtcagtctaatttgcggggtcccagccgataaacctaaaacgggtagagggaaaacaatttttcaagccaacacatatgttcaggtgactgcccatgttaaagccttatttaccattagccctagaaatgaacttgatctgtgatctgccttatctgcttaaggctgaagtctctgcctgaaggcctctcccttggggactacaatctagctccacttctcttatctttcggtaaattcacatctctataaacttagccctccttgttctccagagccgctgaggtgtgcctagaaaccatgctaggcacaaaccctggaaaggattatttgaaaaaaatcagggcagttcattatttgctgtaaagatgactttgcgttattttattttattttattttattattatactttcagttttagggtacatgtgcacaatgtgcaggttagttacatatgtatacatgtgccatgttggtgtgctgcacccattaactcgtcatttagcattaggtatatctcctaaagctatccctcccccctcccccctccccccaccccacaacagtccccagagtgtgatgttccccttcctgatgagttcatgtcctttgtagggacatggataaaattggaaatcatcattctcagtaaactatcgcaagaacaaaaaaccaaacaccgcatattctcactcataggtgggaattgaacaatgagaacacatggatacaggaaggggatgactttgctttcataaaagcctttcccattcattcctgagtctatgtgcaaaagagactactaatgccttattgttaaaaatggctagataactgaataaaaatatataaatttaaaatagcaagaaatatatatatttcttgttattatatatgtttcttgctattatatttctttatatatatctttctatatatttcttgctattttatatatatatatatatatatatatatatttaaaacagtaagaagaggctgggcatggtagctcacacctgagcacttggggaggctgaggagggaggatagcttgagaccggaagtttgagaccagcctgggcaacatagcaagaccccatctctataataaaataaaatttaaaaagaaaaaaaaagaagaaaattttttcatagaactcatgttctttgttttgattttttagaaagtaaaaatcatttcattagaagaagactcaatgcacctataaaaatagaacttccattagattctgaatagctaacattccacaggaaatatgtacaagcaccacactgccaaaactatcatcaaaaggaggaacacaaggaacattccttctttgggaattcaagtagttattttatctcggaactcattgggtaagtggctctaattttccatgagagtatttcattgatatctttaagatatcaatgtatatttcttaactatatttaaaatgtgcatttttctaaagctgcttacttttccttttcatagattattgctgcaatgatcacgtaattttgagaaattagacacttatatctgttatgctctcttttcagtcattgaaaatgcatacttttaaccattgtttttcaatttttctaatgctttattggattgtgtttagtttattaatctcatttactggtagatcattttcaggataactgctgataatgctcctcttaaactttaaatactaaagaataattgcaagaatttgagcccttcattctagaggcagaagttcagttgcctgttgcagcatatttcaaattactatggtttgtatgtaaacttttaccttcttcactttggtttcaaagacattaataacccaaacaaataccattgctaaagacataatccactttagttaaaaatcttattctgtttccatgtgaactgctttctttatgttcttcaccaaatattatgctgaatttctaaaaaatgatacaagaaaaaataaactgtgtgattctcatcatgcccttaatttaataaggaatacagaagctataaattttaaaatatagatataaataatttgatgactgtggaaaactggcatagtagaaggttttgacctaacactgaagtgcttcttgcagcagaaggagatcaaaatatatcacgcccaaatatgccactttggcataaggattattttgagctaaagctaagtgagaatcaacagatatagagagaattatctgccctcccttatctgcctaaaagcagggaataaatttccctttaaggaagatgctctctttccccaacaccagtgagaaagattgactcatcacagaagacagggagtcgacagcagatgagtttgcagaaacagatcttactaaaatagcccttatcttccattagctccttcatatatttactagtcacttttccataagtcaattctccattatctcttgaagcccaaattcttttaagggtataaaagcctgagcctaactgcttctttgagtttcacttcttttctgtgaactcccatgcacataaatattaatacaaattatatgccttgtctcttgttaatctctctcttgtttaattctcatgccccaggcactgaacctaaaaggacagaaaaaagtgtttcctccctgaccaagctgtgatcaaactcacttcagaatgttattacttaagtaatgagaactcacaaaagtgttttttattccaccattcatcatagcatgaaggacatatctcagtttacaataccataccttgatctgcaaaacaaagatctgacaaattaaatgtattaagaaataacatgtctgctgcttaaaaaatatggtaggtgtattgctcccagtaaatatagaaaaaataaaaatccctgcgttccaataacctcacctagccataaggaaccaccacccaggcatgtcggtggaggctgtggggggaacctggactacagcccccatcagtcagtaataagatggcacctgcttactctggtatgagagaaggcctgctaaagaacagttagtgaaatccaaagtcttataaaataatacccccaaatgttcaggatataatccaaaaatcactcatcatatcaagaaccaggaaaatctcaatttgaatgagaagataatcaacaggcagcaacaccaagataacaatgctgtcagaattatctgatacggatttttaatcagccataataaaaaaatgcttcagagagcacttatgaacacacttgaaacaaacaaacaaaagggaatcttggcaaagaaatagaggctataaagaagaaaaggaaactgcagaaatgaaaaatataactgacataaaaaactcaatggatgggccaggcacagtggctcatgcctgtaatcccagcacttagggaggcagaggcaggcagatcacgaggtcaggagttggagaccagcctgaccaacatggtgaaaccccgtctctactaaaaatacaaaaaaattagccggcatggtggcgcgcgcctgtaatcccagctactcaggaggctgatgcaggagaatcgcttgaacccaggaggcggcggttgcagtgagcagagatcgcgccactgcactcaagcctgaatcgcaccactgcactccagcctgggtgacagagtgagactctgtctcagaaaaaaaaaaaaacaacagaggaaagaattagacaatcagacttgaagacagaacaataataaattacccaaactaaacaacagaaagacaacagactacgggaaaactacaacaaacagagcctcagggacctcttagactctaacaaaagatccaacactcatgtcatcagagttccaaaaggaagggagaaagaaggtagggctaaaaaggtattcaaagaaacaatgtccaaaagtttcccaggtttgccaaacaaagatggacccattcaggaggctaagtgagctccaaataagtaaactccaaaaaatccaagccaagcaagatacatcatagacaaacctaaaaaccaaagacaacgagaaaaagaaacaaaaaccaaaaaattttaaagcagccagagagaactaataccttatctttaggggaaaaacaattagaatgacaaagatgtctcatcaaaaatcaaggaatccagaaggaagtggcacaacattgaaagaactctcaacctggattctatatctggcaaaaatatcattcaggaataaaggggaaatcgagacaagctcagaaaaaggaatactaacaatttgttgctagcatacctatcctaaaagaatggctaaagaaagctcaagaaaaaaaaatcataaaagaagggactcaaacattggaaaggaagaaaaaataatggaaaaagtaaaaacaagagctgagaaaggactgaagaggaagcactactagaacaacatagagccagatgaaactacggccacatgagcaagacatggatgaactgggactgtggagaggagcctgtgcagtaggattgtgcagaagtagcgctttagtctctattctaaatatggcagatatgcttggctgcctacctgtcaggcctctgagcccaagcctgcaggtacgcattaagatggtctggagcaactgaggaaccgcaggagaggtgaaaatagccaggtcctgccttgactgatgacattccaccattgtgatttgttcctgccccaccgtaaccgatcaattgaccctgtgacattccttctcctggacaatgagtatcagaagctccccaccgagcaccctgtaatccctgtccccgcccgcaagagaaaaatcccctttgactgtaattttccactacccacccaaatcctataaaactgtcccacccctatctccctttgctgactccttttttggactcagtccacctgcacccaggtgactaaaaagcgttactgctcacacaaagcctgtttggtggtctcttcacatggatgcgcatgacactacccaacagataaaactcccattctttcttaataacaaaatcacaatttagttctgaactgggtatcacatgattaagaggccagttccctcaccagatctacagactaaattattatttgtcaatgccagttgtaatttcattcccttaacaaatacctggtttagtgtgggcttgagaagcagttctaattaaggaatcttgaacagatatcttctgagaggctcttgagaaagacttctccatgaataaaaacttatgcaatagaatttggattaccctttttctgcctttggaagtcactgtgataactgaaaatgtggtagtcaatttcagaccataggggaactcaaacatgaagacaaacccacataatactaaaaacagacagatggaaagaacgtggtttcttaatgatatcattgaagtactgaattaaccaaacctagtattaacctaccttcaaactcatatcatgtgaaataattttttaaatctttcccaaaactctgtggcatcaaattaaaatgctaggcagtagtccattatatgaatatactataattatgtagctatttctctataattggatccttaagttggtttctttcttttcttttctcccccgttataaaggatgatgcaatgaacatctttcagcataaaattttaactgaatttagggtatactttccatggactttgttctgaggagtaaaattactaagtcaaatgatacaaacattttttattccctttgatgagcacagtagcaccaaattgatttccagaaagtatgttcttattaaactcctaccaaccatatgtgtggcctgttttactatatccctgccactatatccctgccaagagtcattattttcccttcattcttgctgacagcgcctcactttaaaagtcttgattagtttaaatcaattttggtaatccaagtttcttccttgagtcttctttttactttaagataataaattatacatactcttaaaaattaaatggaaaattttgcttatgtcaaacatttttgtgctacaaggtagaattgagaaccactcatgacatcacaacggacaatgcaaagagaaataactatttcacttaggttaaggttaattcaaattaaggttaaattaaattgtaaataaaacaatgctgagtagtatcctcttttcaaaagaattagagttgaatgttacttgaacattaaaaaatattgtagcagtcagtaatttggactgtacagtgagaaaaatcattaattcaaaacggtcctcaattagattgcaaaaataatgaatacagagtatatacttacaaatcaaacaccaagtagtgaaagccctcttctgatatgctatcatgaagtcgcactagaaaaaaataagagaagaaaaattgtgttatacctattccaacgatcaacgttaaaccccacttcacatggacatatgtctcctagctagaaatgttggcattacattttattttagcctttgatacgtccgtatcttttacaacatagcttgagttcagatagaactaaggtttgggtactggttctgaaaactggtaactatgtgatcttaaaaaaaaactgcttaacttgtaatgatattagtacctatgctttataaaatggttgagattaaatgagataaaaatccacaaattttgaggtgaatactaaacaaatgttaaggatcattataatatatatccatatactcaaagttaccaggttctggcaattctttcacttccttgccactctctttgctatcaccttagtccaagtcttcaccaactcatgcttggtcactacaacagacagtaagaggaatgattccaagtctaggaaatggtttccctgtgttctcccttttgtccaagaagttctaggtggcactccctggccaacctggcaaaacacagtttttgttatgttacttatttactcaggtcacccaaatccatttaccaagtcattagcccaaaatgtacagcttgaacttttgctaaaataatttactagtttctcaaattaatgccactttaaaattttcaatgagccagactttaactgataactctaaactaaatcacacatgtagaactacaaaccgctgtatctgctatttacttgttcataagccccacaccttgtcccagttatccttcatagagagtgaattctttttttttttgcttatttatttttattttttacttttattttagcttcaggtgtacatgtgcaggtctgccacataagtaaactcatgtcacgggggttgatgtacagattattttgtcccccaggtaccaagcctagtacccaatagttattctttctgctcctctcccttttcccaccttccaacctctggtagccccagtgaattcttcctgtgtatccaaatcacttgaagtggtggcttgatcttcactgggagcaaaagaaggcagggaaagcaacaaagttttaggacacaactgcttttacaaaagtcaccacaaaataataatgattttctactacaacctgttatgtttcccatgcactgatgaccaccacatggaaaatgtgaatttataagaacattcaggttatcacacaaactaaaattatttatacaaggagactgtagtactcattcaatgcccaggctcatagacttaacataatctctgtgctttatcatctaattccatcccctttggatctcattcctggcctcctattaaaatattttctgaatccctctctagatagattatagtttgtaaaatatgaattttctattgttattaacatgaggaggaggcctatactgtaggtgactgggaatgcagccaacagttcagtctcagaccctctacttagctcttgagtgcatgaaatgtaagcacactgcagtccccgctgccctgccacgcttatcttacttgtcacagtgccacccttgaggtcattcatgcagcatattttatctttatttactacctttaatacctttcccttcttcagtatatagtctcgtcaccaatactgcccaacaggaaccatattttataagtcttgcatcccacacagagatctggcacatagtagatggtctttcatcaaattgtttttgagcatttactatagaaggttttgggatggaaattttcaccaaagatagctatatatatgttatatatacacataacacacacacacacacacacacacacacacaatgtatataaataaaataagaagatggctacataagcaattcttccatcactttaatggtgtgaaaggtattcttcacgttgccaatatcagagatgcctgctagccttgcttaaacttatgctgctgaagaatataaagagtttggtttgatggtgcatcttctaatgatcatttagtacaataaagaaagctgggccatggatgatagctcactggcttcttgaatgacacagtttcagagatatctcacttagcagctataatacagtatgtattcaaatgaacttaaataatggcatggcttcttaaagaactcataacaattattctggaaaataagatgggttcccatgttatcaaagttaaactgaaaagtaaagtctacaatctgaccaggaggaaatcaccattactttcttccactgtctgaaggtaaaagccttaggtgcaggtgggatctcaggtgtccagatcgaagaggtatacagctgaacagaggagaatatttcaggtacaactggagaagtagcaataatttctgtctatcctgggaataacattttcttaaaattatttccattcacttattaatactaattaatactaaatatcatcattcagaaatcaattattttttgaacaagtcaggagttactgttcagatggaaacatgataatcaaacacatgatacaaaagcacttaaccagctaacatgtgataagggtttgagacaaatcattcagccaagtttacttcttttgcatcacacaattccaaaataatctctaatatgtctaaccagccatttgaccatgcgagattatgaataaatgtgttattcatatcacatattcagcatcatatttacttgggattaatatatacatatttccttccttcctttattccttccttcctatgtcccaccctacttccttccactctcttattttaaataatgaactgaaaaaacagaattataagaaattgtcatgatttttacttactatattaacaaaagtagatactatagtcttcacagagacattccacatgttcacaattactgtgaggatgggtttgtttcctttaaaaatgtttaactcttcaactattattctcagagttgatggtatgtctaaacggtctggaagatagtgttttagttgtagacatcatctatttctcttcaagccttttctgttggtcaaaagtatccttcatttcctattctttttttcctttttaacagtttctcaaggattgaaaatcatgtttacttttacaaaatgttacattaattattccctataaataactgtcaattcattttcacaccaaaggaataacacaacattctgttcatcacagctgttagctcaagactgacggcatggctggccttgacagcactgcagatgctgcattttgaagcatactgcacctcgttctttctatgactgctctgttattgccataagctgcacatatgagtggacgcaattagcctaattacagttgtccctatgacgtttttagagagaaattttaaaaaagagaatgagaaaaacatttgagaaaacaggttataatacattttggcagtcattctttttgaagtttgctcaaaggtaaaattacgtgtatgaataaatgaattttcacaacctgaaacagcacaacagttctcatcaaattttaaattctggaactttaagtatggaatttataagggggataaaagtgcttctgaggctaaaaatagttccaaaggttagctgacccatggcctaattcttttcctttctctcctgcatgtattatcacatttgaatgattgcaggatcgctgctttctcttcctgttctgtgttcttgcattattccattgcagtttctagctaaatattagctccataaagaaggggtcaaatagaccatggtccttgtatgatctgagaaattttaattaaatatgatagaagttttctatttaattcctcatttcacttaaggggttaaaagatataataaaacttatgttcttactgtcaggcacaatgcaaataatttttgcaagagttatattatttaatatatgcaagcaccacaaggacattttgccataagcttttacaaatgaatgttcacaggcttagaggtatggaggaaacttccaggttaacagcaagtaattggcctggctaggaccaaaatgtagagttggatgattccaaagaccttgttcttactgagaatactacgtgggctccctgaaacctttctgtgaacaaactacttgccaaatacctggtgggatatgaactggtttgtcagggtaaaataatattcaaaaaaaattcaaaagagaagaaataaaaaaattattatggtgactagagaaagaaaagtagtaacaagtacgtaacagacaatttccacagaaaaagaaaaccattttgactgtaggtttaaaatgtgatgctataattttgagggtacagaggtagctagatgatgtctaggatacaaagccacatttgtctctctatacagttcctaaagccccagaaaattgttatttttccacttcaaattaagaatatgagaattgccagtgactcagctattttatctgatagaacatttaatgtaccaaaaatgctagcaagttgaagaatctgaaagcttacccaacatacaaaatatcataaatttaaatcattttcatttccaaaaattaactttcacatcatggacattatgataacatggacaaaaaggtgtgtatgtgtgtgtgtgcgagagagagcgagcgagagagagagagaggaagtggaaatgaatgggcaagggagaagagggaaaagagtaggaaaattaaactccaagtagaaactgtgtcaacagtgattaggtacaccttatccattttgatgacacatgttagaaacacttctgtcaaaagaaaaggaatatattattttattgagacttaatatctttcctaaaaggctgacaggatacaaagtcaatgttttctatttcagtactacttctttcctcctccatttcttaacagtaccccccacacaaaataaaaccaaggttgttaattataattttatgaaattatttatataaaatattatttggttcaaattatactgattcttactctgccatacaacccaaactcactatctgttcctcttcactaaaatttattatggagaggaggcagtcaattacattggtggaccccagtggactatgtctatcattattcatgtccttgtgcagtcccctcccacattacctctgggcttggctatgtgatttgctttgagtgagtagcatgtgtgatgcaagcaaaaccttaatatgttttctacattggagctgtaatcttggaaaccacttgctgtgctaaaagaaaagatcaggttcgattggaagacaagaggccacatgaagagaaacctctgaggataagagataattctgacattctattactagcagaggtcatagctgaacgaaactgcatgaatgacctcagctacagtagagcacccaactgactgaatccagtcaactcatagaattatcacaaataataaactgatgttattttaagccattaaatctgggatggggattgttacctaacaatagataaataaacagaaaagacttaatctgaaatgtgtgattgaccacattgtcctcaaatacgtttttcaatatcataagcaaatttagcagaaaaaaagaatgagtctgacctcagaaagtaagaaagaattagtaaaaattctaaaactgagcatggtagggcaatgctgccaatattatcatgatactaatagagtaattcatacagaacagattgtattatatcctcataatcattgtttgtcagctctgagtaatagtcctggttattaatgaggcagaatttgcatttttagctttgctgtgtttcaaagattgaggtagttggatttggttcacatactgggatgcaaaaatggcagcttgtaagtcagatcctttttatattcccatcagtagttaattataattcatagctaaaacaagcactagccaagttaggccatctaacacgccaagtctaccccaaaagagggaagccaacattaagttcatttgtaaattaaaaataataaatatatacatatatgtattaattttatatctacatacacttttttcaatattacattaaaaatgtaaaaacacacacactagtattagaacattttaacagtcaaattacactctctggagagaaatttcagctcaaccattattctcctggctttatttatgacaaagctgctcacttctagagagaaaacttttcaaatagaaaacacaaaagcactgaaaactaagttcaaaatcaaactaacacttctagaaaagtgaagccaaatctctctatgtggttttttaaaaagtatttcctataacacaagtaatacagttaataaaatgacaccatttgattttcattttcccagtataaaatatattaacttgagtacattagaaaaaatatatgctgtttttttgaaatagagatgttcatttttaaaacactgaatagaaatatagacaggtatagatacatattaatttttatgttgttattaaggtcaagagtcctacatagcatttatactttgtctttttttacttgttttaacatgaaactttaacatttgagcataaaaaattgggagtttgattagctggctaaggcaaacaaatgaagtggtcaggcttagaagccacaatctgttctaattttagctatttgaacacataaagttacataagggatatgtatttttgaaaaactatttagcaatatgccccatttataaatgccaaataagtaattattcatcactcaaaagttaaaattaatttctatatcagaaattgaaaaattatagtaaaatttcagatattcttcctgtaatgacaaaaaatctaccttgtaaacttaatatcaactaaaattaaattatatttcaaagcaattgactgcttacacttaataggaatgaaaattaactttttaaaataatcaaatgtaattattatatgaaaacttcatagggaatgccatccatattactttaaaaactattctaaaagtacacaaagaaagttactggatcccaagataagtcctgaaggtcaaagcatatcaactctggtgactatggtctccatccttattcccaaatcctcaccccactcctgattcaagattaaaagccaagtttagattatcttcaatatctacaggatcagattagtataatagcattcagtactgactagaagaaatcattatgccttttataagccagcactaattagaagcctagataatccaactgggtttctgatgggtcaaaatagttattacctgggagaatttcaacctgggaagaaattagaaagtgggagatatgatcagtaactgttgactgtatgggtatcagccacatctatcacatgacactacaaacagcatgaaagaacaatcagttcttttgcttgaaagaaaaacgtcatcaatggctaaatatagaagctcagagaagactaaaacaatataaaagtaaataggtaattcatgtaatactctgtcctgctcatttttaataaaaacataaatttaagggtaaagtaaataatagatttagtaatatctggaaacattctttgttttctttgaaaaataatttgagattatcctgttgtatattttaattgaataattccattctgcttattttgttttctaaaaaggtaatttcatttcttggaaaagttgatactcatttcaagagtattgaaacaatagtcatttatatagaaaaatcttccttccctctttaaattttgcattaatatcatttgttttatgaattttgattggtgattccaactttcctttcttcttgccttatgtttttgttattctatcttccactatgtattgcaagttagtcagtgatctctcatcaatatccttagccattaggaatattaaaaaagggctgggtgcggtgacttacgcctgtaatcccagtattttgggaggctgaggcaggcagatcacttgaggtcaggagtttgagaccagcctgggcaacatggtgagaccctgtctctattacaaaaaattagctgggtgtggtcacccatgcctgtagtcctagctactcatgaggctgaggcaggagaatcgcttgaaccagggcagcggaggttgtggtgagctgagaaatcgccactgtactccagactgagcaacagagtgataccctgtcttaaaaaaaaaaaaaaatcaaaaaagaagagagacatctgtcgtggtctatcttactgtactctctgaaccttatcagaaattttgatgattatgggagaagtaagggaagacagacaatatatgggaaaagcaaaggtattcctgagaaggcacatcccttgctgatgaagagttgttacttctgtaaggaaaaacagaacaattttttttgttcttaatttgaaatggggtcttgctatgttgctgaggctggcctcttgaatgcctggttcaagcaatcctcctacctcagcctccagaatagctgggattacacaaacaccaccattcctggctagaagaaacaatttttaaaggagataaaaaataacaagaataaaatcaaacatggtgaagtatatttcacattaaaggtaactattgctttgtgaaacttttgcttgggtcatacacacacactcacacaacacacagacacacacacatatatatatataaaatatacactgggccatgatataaaacattttttatactctagctcacagtaagtaatacttgataagcactggattagatgatcctttaagaagatcctataagatcctttctaagtttttacatttctacattcctggatgaatatggctaataaatagtataggaaataaacaatacagtaattaccaatacaaagctgaatatgattctctaagtgtaagagttttctctcttcaacactctcgagttaaagtttaaaacatacttcattttattttggaattgtttttaatgaataactagagagaaaacatagaacatttatcttgccaaaccaaaaatatgctcttcaaaaaattaaccgagcagatgagctgcttttataacactagcccctggagaatagtaaatggaaaatcttattagatcatcttctctttgtaacttactaccatattatcttaacacttgcaactgtattttccctagagactcattagcccaaatgctctcatctttcaattccttttttgaaaattcatttattgcatttttccaaagttgatatgtcctataagcaggaaatctgtgagtttaaaatcctaatacatgttaagaaatgcaatataactggcttgtagacatattgtactataatattatattatccaataacatttgcctctatatatctatttttatgatgaaagcacttaaaatatcagtttatttctcctggataatacatgcaaaagaagtacatgaaaaatacattctgtaatcttaggctcacaatctgggaaaaacatgggagttatttatgaacttgctcatgaattagatgccatgggaataatgaagaatactagtaaatatagctgcaggcaccagtctgcatctatcaggcacctaatatatttttatctaagccttcgagagaacagttagttcagcctaggtcaatgatgtttctaaagtaaagaataattatctatttatcatgaaatcaaggaagttataatgaatgtcagacatctcaaacgtgtggtgcatttgcttgtttcacttatctcatagacatctcaaaccaaacaagctcaaagaactcgtgatcgtccccctaaaacctgcttcatccatggtcttccatctttccagttgctcataaaaaccccaaggtaattcttgaccctttctgtgaaagcaaaatctaatctgaaagcaaatccttctaaatataatagggtgagatggaatatacatacatatatagaaaatctgaccacttttcatctcctctactgttacaagcctgatctatggcaagtccagtagcctcctatctcatttctgtgtttctaccctgccctctcactgtctttaccacagcagccagaacaatcctgttaaaacttaaatctgattattgtccttaggttcagaatcctccaatggctctccacttactgtctctgagtaagagcccaaattccattcatggcctaaaaggtccctcgctccaccctcattatccccctaacctctcctactactcatccctggcccattgcactccaacttcattggcatccttgctgcttctggagaactccaggcaagctcctgtctcagagcctttgcacttgatgtttcctctgcctggaattatttccccgatattcacatggctcatggcctcatctgttttaagtccctaagcagcttttcagagtattcatttttgtaaatacagatttttttttggaacatagccacatcaatttgtttacgtattatccatgttggtataaagctaggatttcattgtttaataattgcaactaagacatgtccagaaaactgaaaatacaaacccctttacagaaaaagtctgttgaccgctggagtagagggtaagattgctgaaagagagaatataggtgctgagaggccggagtttggcatgcataatctatgtggctaagtaaagccatgaagaatgatggcagaagtggaaaggagagaacgtagtaagtcagttactatataatacaacaaatgatgggaatcaccaagagaatgatagaaaactgctgcactaagaatgtaggatgttataatctaaaaatgtgtttctcaaagatagggttgggtaaggatggaggtaggggatattgaaggaggaggtgttaactatggtcttataaaagcagtgaagagcgagaaaacatctgtccatcccttggttctgtggtgtgtagaggcccaagaaaacagccaacacctccaggtgctgcagataaagcagctcactcgagagtcagactgcagtcagcacaacaataaatgaacagagattattagagaacagggggcagtttgcaaatattatgatactagacttattattgtacaattaaagggaaaaagaaaactaatgaaaagtgtgaaaagttggcaactttctcacagtctaggcattaaccaaacagttattcaaattgcttaagattcaaacttggtaaactttcttatttttttacaagagtttttttttttttttgagacagagtctcactctgtcaccaggctggagtgccctggcatgatcttgactcactgcaacctccgcctcccaggttcaagcaattctcctgcctcagcctcctgagtagctgggactacaggcgtgcacctacatgcccagctaatttttgtatttttagtagagacaggatttcaccatgttagccaggatagtctcgatctcttgaccttgtgatctgcctgccctggcctcccaaagtgctgggattacaggcgtaagccaccacacacttctatgagcgatatttttaagtaaattatatttttaagaaccaaatttaagaaatataatttttggtattttattactattatatttccaaaggttctaaatcttattaaagtgtgattgtgattttacatattttttattttttggagacagagtcttgctctgttacccaggctggagtgcagtggtgtggtcaaggctcactgcagactccaactcctgggctcaagtcatcttcccatctcagccttccagttactagaggcacacaccaccacacctggataattttttgtttttgtagagacgaggtctcactacgttgtcttggcttgtgattttaagtgtttatgcatatgtcctgtatttatagcatctgaattatttagagaacaatcaatagttactctgattttattcactcattatataaagatactatatcttcatacttggtctgaatatgcattttaattaagttttcttcctagttcttatatgccagatgaaatactgtaaaaaatgaataaagaagatacattttaaatgttctcaataaaaacacccatatgacattaattctttttctgatgaaaattggttttgccacctctattcttaagcaaactattttgtcaaactgtccttcaaccctgaacaaaaaaacattaatagaaaatatgttccaagattcttggaaaatatatttacgtctatattcttgactagagtcttcattcagagattctaagccaatgggataaatgagtagcttcatgaatagttgtacctaagatttttaagaagacagagcacagtattataagaaataaggttctgggagggttcattctttcagtcactcagcaaattttcttgaatgctatttgctggggatataactgtgaacaaatcaaggaatggtgatctcagcactcatacagtcattaagacaaaatcctctcactaattttgtaattctgcattctggattattggctttgcagctaaggcatatcccataaagcatgtttcattttacagtcttctcattatccacgcccagggaagcacaagaacacaatataactatgtggcaaacaaatctaacaagtcataggttttaactaaatgaactacgaaatgtcttcatctatatggggctactaaatcaacagtctttatccactgacaaactcattaaatcaaacaacatacttttctgatttttcttttttttcaaaattaacttgctattgagaaagtttaacaaattgtttaacctgaaagacaaatttcctggtaaacaaccatttaacatcccctgtgtctttgcctcaaatccattaccaacaaggcagtcatcctttcaaaatgcaaatctgattatatcacacttgactagtttaaaatttgtcaacccttcctattaattttatgttgaggagcaaacttcttaacgtgacccatttatcatgtatcatccaaactgggacactctgagagtgaaaagagagtgattaatttttataccagtaaaccaggacagcccctagaaaagaggttagtgtggctatcccacccacaaggccctacctcttcaaattccttcacattctccctcactgtttcccctccagctccctccagcaggcatctttgttaggaaaaaaataatatagctgggcacagtggcttatgcctgcgatcccaatgctttgggaggctaaggcagaagtatcgcttgagcccaggagttcgagaccagcccgggccacaaagtgacgccccatctctacaaaacattttttaaaagctggacgtggtgttgcatgcctttggtttcagctacatgggaggctgaagaaggaagattgtttgagctcaggagctcaaggctacagtgagccatgtttgcaccactgcgctccaacctgggtgacaatgaaaccctgcctcaaaaatatataaatatgtatctccatattcaaaacctgcaaatggccaaaagaacacatgtccattgaatgacatgatgaaacactgtttaactgactcacctgaggattatctaattctctagaataggtatctttattttgttttatttgctattgattaggctttaatcaggagtctgcaaaccatggtctgtgggccaacttgggataggagagtgtttttatatagtccatgagcataaggatacgtaacagagaacttacatggcccacaaagcctaaaaaatttactcctttacaaaaaaagtttgccaacttctggattaagaaaactgatgatgctgaaaatgattctcaaaggttatacccttgttgcctgtaaagcaataaccagtttagttttatggcaattacatcctagcattctttttttcagtgactatgcatatttctgttactcctacacttttttgaactggctttggcatcttgctagttctctcattagtaaagtattctgtgataagtattttataaaaaataaaatataaagtattttgtaaataagtaataatgactacagattaatgatgatcaatgatctatcatgatgtgtatatacacacacacacacacacacccacacagacacaaacacttatagcatgtgtcacttaactacagagatacatgctgagaagtgttgttaggtggtactgttgtgcaaacatcaaagtgtacttatacagacctagatggtatagcctactacacacctagcctatatggtagtgtatttctcctaggccacaaacctgcacagtatgttactgtactgaataagcaacaactgttaacataatggttagcatctgcttatctgagcatagaaaagataacagtaaaaatatggtattatctgaccatcatcaatgcaggcagtctgttgttaactaaacattgttatgcagtgactgtgtgtgtgtgtgtgtgtgtgtgttatgttttaattagtaaatatatcatgttatatgaatgtaccattatctatataatcagtcttctgtgtaaggacatttgaattgtcttctgtctcctgttcttcagccctatcactctcactcaccctcaaggagcttctcattgtgtattaaatatgtatacatcaccgagccaggatttcaaggtcttctttggtccagaagtatttaactgataatctattgtttctgacctctgagatcctttcctggaatgctgcctactccagtccctaccatagaagccctactcttcatgcttaaatgccaggtgctcacagttcatggctcaatggagactttccttctattttctgtagttcttggagcctcacttctagtaaatttaaggaaaataggagactcagtcaatcttgaataagtttaaccgccttggaagtaatacatcctaagatttgatatgtaacaggtaaagaaaataaaaagtatgtcaaatttccatccacagccaagatgtaccatggaaagatgtcttgaatataacttctacaaaaaataagcaagcaaacttgaatcttttcaatcaccttataacatgcttggtataagataatatttttgctaattggcaaaaaaatagacaaatggaaaataagtatttgctgttgtacttacatgccttaatcagttacaatgaacattcttgctcacttggcaggaacggtgggcatattcctttgctctgactttatatatattaagtaactttctgttcttaacttgccttcttatgtgaactttcatacaagtgagacaacacgtgagcagtaaacacagtagtaccctaaaaggaactgtagtctgcaaaatctggtggtgtatttctggtctctgtatttactgtggctagtatattctggcatacataagaaactgcgttgaaggaataaatggattggtgtatcagtgggttgttttaggctgagtcagtgtcttaaaccaaatcatctctggtgaatgataagcccataattttgtaattagaaaataaatggaaagtccaaactttagacacatggtaacctataatcaacaaataggcaccataagaattgcagagaaagctgactttcaactttatacaaaatttaacatccttttagctacaataatagttatccaaccttgcattgttctgaagttttgtgtatgtccttgatagaagcaaagtcttctcttctttctgaccaagcacatggaatcagttggaagagaccacctgcctagtcagccagatgtctggtgatcaatggagcagatacaggaggtagcagcaggatcagacttatcttctagttacatgtacatacttctttaattcatggaatgttgaagacagggagcaggcactcaataaatagtcattggtgataaattccttattcttccagtgaatatttattgagttcctacactgggcaaaatattataggtactaagaataaagcatgaaacaaaataacgtgcctgagctcacaaagtttatgtgcaaatatgagaagactgatcaatattaagcaaatatgtaaatatatacataggaaattgataagtgttctgaaaaacaataaagcagggtaagagggaagtgagtaccagaagaagggaaagaaagggtatttgggaaaagcatcactgataaggtgaattttaaggagagaccagaaggaaatgaatagtgtaagccatggagatgcctcagggaagaccatatggaagatagacaaaagcaaatacaaagatcctatagcaagactttacttgaccagtttgagaaacagtgtgtctgtagaagagtgaacaggggagaaggcagtagaagatgagatcagaggtgtgagtatcgggggtgtgagtatgaggggttatacagagccttggagtatgccattattaaaggctttggcccttcctctgagctagatgggaattcactgtagagttctgaggagagggtgatatgctctgcttgttttaagaacacatccgtgactgacgtgttgaaaatacactgtaaggaagcaaaggtagaaacacagaaacatgcatgtaaaaagtcaggtgatgtaatcccagccactctagaggctaaggtgggagaatcgcttgaacccaggaggtggaggttgtagtgagccaagattgcaccactgcaccccagcctgggtgacagagtgagatatcatctcaaaaaaaaaaaaaagtcaggtaaaagataacagagtttcaaaccagggtggtgacaccaaaggtacaatgagatcagattctgaatacattttgaaagtagagcagacaggaactgctgagagagtgggatgtgagaggagaggagtaatgaatgatgtcaatgtcctcagtaactggtatactggaatatatgaagatggaggtgtaacaggttgaaaagatggaagtaaattggaaatgccaaatgtatcatctaacggagaaatcaagaaaaacaaattcattctttagtggatgaaatctactcttggcctacctgaatataccactttaaaactaggtatcagaacattacatgttgtgtttgagagcaagagctctaaagctgcatgaatgttgtgtactattgttattattaaattacattaaaggaaattgttattaaacatttgttttaaattctgcattaaataaagttgatacatttgttatgaataaatattacatgaaataaatcctttcatactaggcagttattttaccatgtgggacaatagggtttcagagaatggatagcccaaggaagaatagaagcacttgactggatcaggaagtgttggttcaggccctgactaccaatagcttgctctccaatcttggcaaagtagacagcggatctggacctccattccttgcaggcaaatagaagggttcagttagatgggactcagctgttttcttcaactggaacaatccaccagcatctaactttaaacaacatttctcgtaatgatgatgtataattcacaatgttttaaaaaaaactctcttcagtggagatttaggatattggttaagaagggcaatttaatttcgcggtatgatgaatcaggctcatataatccagagaccagggaattcagacacaaattcaacattttacttaggttcacttttattcactatacaaatgaagaattaagatttttcatagagatttgtaaaaatgttttttaaaaataggcttgttttatacatgaataaagcagcaaattattacatgtaaaattcttattatttccctttaatcattgactgtcctatgatgctctctttgaagtgaaaaaaagcagagaaaaaatacatttgaaaataatgatattatcctattaatgccattaatggatggttgcatctctatatagaaacgtgttcctctataagtgaaggttaatttgattctttcaatttatatcatttttccattacatttcactgtaataaattttggacttcttaatacaggtgattcttattatctgcagtagttatgttctataaaatcatcatgaacattgaatgagcaatatactaaaccactgttcctgggggaaatacagggttagtttcctgcaagcccctagtcacaacatttctgtcaactaatcaatatataacctagttttatgtgtgtttctgtttaaagagatcttaactgatacacattgttgattcattgacattgaacccacagtaaaaggcattacaactcatgcatgaatgaagcttatctaacacacagatattttccataaggcacatcacaaccttcttgagcttaggaactctagacagcactgcagctttatatttggggaccattttaaacaggaaaattagcaaggaaaagcaccaaaacatggcattacatagatggtgaaaagggcatttgcttagtgtttataaaagcttaaacaagaaggcaaagtggggccttattagaccttagctgggtacacacatgcacacaatgtgactcaaacatcttgctgctctgcatgtctgtgaaggtccacgagtgaccaccaaagggcttcaagtacagatgggattacaaataaattttccaagagcaggcaaacttgcagttacagaaaccacaaataatgaagatcaactgtatttatttcttatcaactgatcatggctcttagccctttaattatatttatctgctctttagaactactatcaagataactgttgattaataaacacacttaactgtagatgaggaaatcaaatctatgtggttaaccattcatgaaatttttaataaatcaattaccacctaatcaatctactttataagtttgcattttgtagatacgacctttctaaatatttaatattgcatgaattataaacactactaaaagagtatctacaaattatgacactgtgttagagactacattagcaaattacactacagtttataacctactagaagattggcttccattcaggaaaggaaataaaaaagaaatagaaaaggaataagaaatatagccttgttaattttaaaaagcaatctttaatattaatataagctataattaacattaatgtgaaaattatatttaaaaatgcgcagtaaaatcagaagtctgggtgacctttcttctggattcctgccgtgaaacagtgaagtttgaagtgattttgttatctatcatactctctgatcctctcaaaggacttatctttcctggtacaaagcctctgggcattaaaattattcatcatttcatgacatatttggggctccctggcaaaaacagctctctgaagatgatgcacgtaaataaaacgggtataaaagaaagtcttgtattatgtaatgaaaaatgaaaagaatgccctgttgatggtaaaggtaattttttttccttcttttaaggacaataaaatcatagaaaataaaatgatatcagtatcattttggaaaagtttctatttttaatatctcctaaacaaaaatgcttttgaactaagttgaaggtttggctgaacaatctgtgaacaagaaaaagagctgctgtacctggtcctcttgcttcaagttgccagtaatacaaagccaaactgcaccaacaatgccaagctcagttggaagaacatttccaccaacgtaaataatatttatttctagaattgaacaaaatacctaagcagtaaaatatatatatatatataactcagcagtgcactggaattaagggactaatgatttttatctgcagcatattccctcaattatataattcattaaacacaaagaataatgaggaagaaactgtgctaagtatcaggctgaacagaactacccattggacagagcctcggaaaaccttttagaaactactaatgtaattaaatcatctgaacaaacaaatttgtatcagaaactccaagaagctaaggtaataacaatttctgagcaaccatttttgccatagtcaattttgaaaatcaaaaatagactcaaatttttttaaatacttttttaaggaaacatggcattaactgacaaaaggtaaatttctggtttttaaactttttaaaataagaaataactttcagtaaatattacattccatacagtgactcaatgcatatataaacaaataatatatatacatacataactaaaacataagttacagaaaacaatacttaatcttactacatgtaatatactctgacatttaatgaaatttatctcactatatttagtggtcgttaaagggtcataatgcacagtttgaaaacatctagacaacagtatttgttatacctctctcagtttggggcctcatggctagtagtgaattgacttagcagtgaaaaaaaatttcatctcaagttccttggatgataatatatatcaaacaaatttactcttgtcaattggattatgttcttggtaaaaaaaaaaaaaaaatagaaagggaggaaaaacaaattctccattctattattttattgtgatagctttcaactctaactttgggcagacttacatacaggaaatgatgtataattcacaatgtttaaaaaaaaaaactctcttcagtggagatttaggatattgattaagaatggcaatttaatttagcagtatgatgaatcaggctcatataatccagagaccagggaattcagacataaatgcaacattttacttaggttcacttttatctttcttcctattcacatctaattcaaatcactatactacaatatccatttgttaggtagcaaaaaatgaatgcgtagttattttcaatgaagagaactgtttatacagagttgaattgtttgggcatggaggacaaagcataaaatagaatagtttttaaaaatgccttgagaaacattatcaatgaatgtttccttacacctgatcagaggttttgcaaatgcatgtttatggctagttttctactttgttcattcattcattctcactaaaattaatgaattattagacctggggttatgcggtctttgagaaaaatcacttgcacatttgttcagtcagggttcttaggattgttgactgcaaacacttgggtatacgccatcaattctaagaaatttattaaaccaatattgaatagcttccagaattgttgggagggctcaggaataagtttccagaaaaaaagtcccaagactaagcttcagaactagcctgatggaaaaacagctgccgctacatctgctgcaattaataccaataatatatgtcaactgccaatgccaccaggaccaatgtcactttcatatcaaaaattaaatatactgctgactcctcaaaccacagccctcgaccaccacattcactgagaaaaatggaaagtctgtgcaaaatctgccttctgacactgatgaatccccaaatgaagtatggcaaacatctgttagatgggacaagtctacaagcctagtgacatgcctgcacactggctgcaagaaagactagaaatttgacttctgacttctaagttgctaagacataactcagagtgttgtaatttcatgaatttagaaagtctactcaaatactgtggatatgccaattgtctagcatattagcattttatgtaacatatcatggatcacgacatattaaaaaaatcaaatctcagaatttcagaagtgacagggacttcagaaaacaattacaatccagcccctcagttgtactaatggagtccaggggctatctattcatttaaaccagagccacaaattggtattctaaagtctgtgatggtcttttacattaggccattcaaaaatcacctcttcttatctcctatcactagtgctatttgtgagcagagaatggttcagctgagattgtagactgaatatggtggctcatgcttgtaatcctagcacctttggaggccaaggcaggaggaccacttgagcccaggagcttgagaccagcctgggcaacatggcaaaacctcgtctccattttttaaaaattaaaataaaaaataaagcaaagaaaatgtagggaattattatgttgaaggtggtacattgataattttaaacatcacccagacaggctgcagttgacatttccaatattcaatgaacattcgccctttaactgtgagaatctgctagctagtgattttgtgagttattgcccattagatgtagggcttctggaacacatcggctcctctctacacaccaacatacaaaacagcaagtcatacgcctcagaaggatgacccagaccaaaaccaaaatgttagctgggtaactattgtcgttggcatctatttgcttttcattaggttggaactgaactagagcttcagggagatcaatgagcacagggtgcagtggtaaaaatgtggcaccataaacctgcttgcaattagcaacagaacctgaaaattaattcagaaagtagatacacgtcaacactaagtgaagaaacaagtgttctggatgatgagcatgctttactactatgatggtgaaaataatgtgtccttatagagtttacatacacttgaaagttttgaaggaaaatgtaagagaatagggactccaatgatgaaattgtagatacaagcctgctttggttagttgaaacagtattatgtagaattgggaaaatgataggcatatgtatttatgatcctccctcaggagctttggcttaagaagttacaggctaacaatacttgctatcacttattatacaatcaaagcctatatgatgtgaatagagaggttcctgatctaagtggaaacattctccaaatccaaaacaatgaaatatcaaacttctcataaattccctctcattctatatgtgtgtgtattatcattattattattattatttgatatggagtttcgctcttgtccaggctggagtgcaatggcacaatcttggctcactgcaacctctgtctcctgggtttaagcgattctcctgcctcagcctcccaagtagttggaatcgcaggcatgcaccaccactcccagctaattttgtaattttagtagaaacagggtttcattatgttggtcaggctggtctcgaactcctgacctcaggtgatccacctgcctcagcctcccaaagtgcttggattacaggtgtgagccaccacgcccggcctgtgtgtgtgtattatttgattgtgctattgcactccagcctgggtgataccccatagagagatactctgccaggctggagtgcagtagctcagtttaaaaaaaaaaaagaaaaaaatcaaaggaggcagagagagctaataatattcatatgacctgtaagtcattgtcctgtcatactattatacataatgtagcataatatagtcagtaaatgttaccctgttaaatcttggtttcaaagtctatagacactgacaggtgctttcagggagaaacagaacagaatgtgaggagtttcagatccaatacttaggtccttgtcagcttgaactgaatctcaaagtactaaaaagcatcataaaataatgttcaatgcatatttccctaggactgagaaataatctattcctaggcataaagtcagccttatggttttcaaaaggtaatttgttttcttaactatctgcttcaaatgaaggaatagttgttttgttatccaaaggcaaaagccaagataatctggacataaagctataaagtaaattctactgaagaatatattagaaaatttgcaagtaaatcaatacgaggaaactaaacgtaggcattaaaaggcctatatgttgagtcttcatgggctgtgagattatctatgtatacaaataaatttaagaaaacattatctacctatccatttatctatctctgccatttttatgcacaataaccaaaaggtaattcccactgcaggtaatttttggttatttccactcaaaggctacctcaccatggagttaccacaattccttggttttcttcaaaaaggtattaatattttcaaaggacatgattcaggcagcttaatacagaaaacaacgtcaatgcaggaaagaaaacaatagcaacaaagagtgcaataggacaccaagtccaataccagcagtcactgctccaaataatgtaatttgtaaatcaattaaaagctgcattcatagagatcaggcactcattcagtttaccaaacataatcaaattacacttccagggggaattaatgtcacagtatatttagtcattgctacaactgtcatttccaataggataaataaaataatcccaggcctccatagctgtcactgagatagtacagaagtgactgttggctccacaagcaggatacctggcatgcagtaccagctcagccacttactgggtaactgtgggcaaagtgcttagcatctctgccttctttccctcaatttgtaaaaatgtacataatataatgtgctagctgtgtctgctaaacaagacaatccatcagagggttgagcatcatgcctggcacaggatttacatttgataaatctttagtagttgttataatttgaagaattaggttcaaaaacttacaaccacacaatagttggaaaaagcagcattattgtgcatgttttattaaaaatatttctggagaatgtctttacttgcttttaaaagacttttgtcacctttgcttttaaaagacttttgtgctttttagcacaagtagatggcatagtccaatctgtagtacagtcccacaaaacactgaaaatcatttcccaaccttccaggctgttgttcacaaaagagcagccttccaggtttccctgttccttctcccctattctgatcctgtacagctgtctatattttcatttacacgttgtagggaatagacagttttgaatcattcatagccctgtccactgctaggttctgacatatttattcaggcttgtctgggaaactggaaaaggtatcgactttatggagagagagacctcttaggcaagaattctttcaaagcaaagacagaattgggcaattaatactgacccaccaataaaatgaagagcatggtattttatctatttctttggtagggagagaaaagtaggtaagaaaaatccagaatttaatgaggagagggaaaaagcattattgagcataaaaggacacagagtccaatgctggcagtcacaggtccaaggaatgacatttgtaaatcaattacaagctgctttcacagaaataagatactcattcagtgtctgcttccctcaaaattgcatatgacattgaggtagaattagcactagagcgtttttgtttctacatattaatttgacatctatttcttgggcattgattctgtgccaggagactttataggtattggagaatcaaaagtaaataaacagtcatgaaacaaaacctcatggaacttacattactatctatctgtgaatgcagccaaggcattcccccaagatctgtctagaatacagaggtaccaaggacttgaacttataggatctttggaagcctagaaggccagactctctttacctaaaatatgcattacctagccttgtaattatcttcacaaaatagtacaccagctcaaccctgaaatatcagagcaaggcggcaatgtaatttttgtcctatgagaggttatcaacaaaaatgaggggttagcaagtcacttggtgtcataggcaaatatttatataaagatataattgattgctaatgctgtatgcgaaagcactttttgctgggtttttacaatctgacctatgagaaagaaataatcaaaatcattctttcctttgataagaacttatacttcctcctggtaaacagggtgtccaagtgtgcacatatttatgcccaagcatttctgaatgtagcttacagcctaaatccaacatatattgtgtgatatattataataatttgaccagttattattaagaacacaagccaagttaaggtcttttcaagctctaaaatcctacaatttgtgtgggaaattgtactgcaattaatgggcactgtaatagatcctttatatatagaatttctaatccttataacaatgtgaagtagtcttatttccagctttacagacttattttcagaaaaaggaaggaaaaggagcttatttctgcaaaaacagtacaatggagtatccaggactcaaatacaagtccattgtacttgaaagctggtactttcaaactagtccctggccttcacaaatatgttagtatgttaaatacttgtacttaacccttacaagaaaatacagtgggcataatgtgaattagggagtggacaaatataatagtggagaaaataaatattccctgcttatgctttctagttggtgccttttttggttttaatgggtaatctgcatttatggtatattgataaaatttgtagtttatctgtaaaggttgagaatgaccaatgtagaaaggatatgttttagcaaatgcaagtgcatattggactgatagcctgctgacaggagctgtacagctatgcctgtggttaaagcaggcatctgctttgattggttggttctcaagtcatactggttatcaaatattttaaataacattcctgttgcatgctgtcaacttctgattttatattcccaaccctgaactctctaccagatttcagactcacatccaatgacgtctttggcatctccaactcaggagtctaataggtattctaaaattaatgtgccggtaacaaatcctttcatcttcccatcacaacattctacctcactcccagctgtgtccacctccactgagacaactctatcctcacagtttctctggatttatccttgacctctctctgtccataataactcatatccaatccaccagtacattcagctctactttcaaagcacatcctgcatctgaccactgtgttctatttccattgctgctacctcaattcaagccaccgattactccaactgtctcctagcaggtcttccagcctctgctttggcccttgcagtcctcttgcagcatagcagccagagtgatcctcttcaaccagaagtcagatcagctcactcctctcttcagaacttgctgaagccctcctatccttaataatctactcggactgccataacaaaacaccattagactggtggcttacacaacatatttatttctcacagttccggaggctgggaagtccaagatcaaggtacaggcaaatttggtttcagatgaagacctgcttcctggcttgcagatagatggcccccttgtcactgtgaactcaaatagtggagagagagctctagtcacttcctcttcttataaaaacactcacgctatcaaggaggtcccatcttcatgatctcctctaaatctaattacctctaaagggccctatctctaaataccatcacattggggatttgaacttcaacatatgaattggggaggtgggcacaaacattcagtccataacaatcccactcagatggaaagtaaaggtcttcacaatgacctagggcccctgccctacttccagtcccctcactccacaccacactatgctgcatggcctgcaagctgctcccatccttgccagataaacccccatctcactaccccttagaggctcctccctcaggtatctgcaaggcatgctccctgacttccttccacacttggcccacttaccataatctgaccacaatctgaccacaatatgacaggctttttttatttgtttattcacagcccctgttcccagaatagaagcagtataagggcaaagaattttgtcagctttgcttattgatgtatcacaggtgtacagaagagtacctaacatgacagatattaaaaaagatttgctaaatggatgaataaatgtatgaggacaattttgtaggacacgtgtaattctaaatatacaatgattttcctacaattctcaaaatagttctatattcaaaatggaacatatcccccaatgtttcattttgtttttcaaaataatgtaaaataaaatatatcaaatggaataagaaagttgagtgagtgagtctaagagggagttaaagtcccattagcaagtttcataaacttgtgagtccttatctttcctcctgtggtttcatttgtatttggtttcagaaattctcatcgaggaagctaaatgcaatcttttgttttggtttgggcacataatcaaaaatttttagctgcaagaaaacagtaatccaactattcagggggtttccttgaaatctgtcccttagagatttactgtggtataaacttggatgtaaatttctataaaatatctacctaggaagatataatctgaacttttttcctagaaactataaaagtacacatttttttttaatccataggttggttcccaggcctctaccatgcagagataggctgcctggacataccagagttgaaatgtttttgaaataataataaatactaaataataataaatactaaatctttatacagtttccaggatttgacaccagtttgtggaccaaaagcaagaaagaatagcagccttgtccaagcccatccttaaccaaacatatagctctccatcctccttctcccaaatatggtattacacatccactcatctcttagtgccttccaatttgtagcttcagagctggctcccctgatcactcctctaatttctgaatcctttctgaagctaagagctaacagtgcactcaaataattctgtgcatttacccatgcataatatgaagaagctaattcaagtgaagaaaagggaaggctgactgaggttaaaaacaatggagcttgaacaggaacacagaaacagctctgactagaaagacaggtgtgtgtgtgtatgtgtgtgtgtgtcagagacagaaggatagagacagagagagagaaaatttgagagtgggaaccacagagcacaagaagaaaaatgagatagaggtttggagaatatgagcctgcgaacaatgagagaggtaggagaaagtatattattttcttttctgaggtgtgattcccatagagaatatctcccttgggggtaggttagatacctacgagatgcaaaacacaatgtgctctcagttctgccaggtacatatttaagagaacagtttggagttaaaggtagaatgcagttggaccactttataaccttagcaaagcggggtttaagaaaataatagaggaatttcactctcagcaaacagggacctgtttcggtaatgcgaactcattagggctatgctcctactcagcttttgtgcaagcaactctagataaagtgctactcaaatatcccccaaatctgtcaccaacttaattcagacaccagaaaaaaacaaaaacttagagaaacagaggtagtccaaagacatgttagggagacaattgtggtaaggtggaatttctcatgtgaatttaaaagtttatttaaaagtgaatgtaaaaatctacttcctcctcttcccaggcagctaataacctagctttattgttaatcagaaaaaaataataaatataaaaatgtaggtttggcacggtggttcacgcctgtaatcccagcactttgggaggccaaggtgggaagatcacctgaggcctggaattcgagaccagcctgggcaacatagcgaaactttgcctctaccaaaaaaaaaaaaaaaatagcccggtgtggtggtgtgcacctgtagccccagcttctcaggaggctgagggaggactgcttgagcccatgaatttgaggctacactgagctatgatctcttcactgcactccagcctgggcaatagagaaaaatcctgtctcttaaggacaaaaataaaaagaaggaaaaagaaaaaaaatgcatagtaaattgtgaaagcagtggatatgaataggcaagattattataccatactctgtgctggatctaatgacaatttgtttgctaggccctgaagataaaaagtgaatgaggtccctaaggccaaatggctttttgtggggggaataaggatatgtaaataagtaatgtggtaccagagccactactagcctgcatagggccactgtgcaaatcagaaaaaggaagccctgcaccagcgctgactcactccttcagccaggcacctttgtacactacaacacccaccctagaataccaattaggggcatcagggaaggctggggggtgatgccaaagatgaggcctaaacagaaaggaggagttcagccagacaaagtgggagggagaagaagagcgtctcccaccaagagaatgtaagtggaaaagtaccaagagaagatggaaaaataagaaattacagttttggggagggagtctgtatggctggagagtagcaaacaaataggggaactcaaaatataaaggactttgcaatgtcaggattttagaatttagcctgataaattagggagccatgggaggattttgaggagagtgacagatccgagttgcatttttaaaaaaccccattcttcatagcaaagggaagaattcagaagagggaaggcttattaaagcatgtgggttagggggaggggatagatttaaaagccactgagaaagttgaagggagaactgctaagtgcttatataagttggcaagggaaggagaggtagagaggatgacaccagatttctagcttgggcaaggcttatagcagggaacacaagcagagaagcaggtctgggtgggagctgagtggggcaagggtggaaaacaagttccattttatgcacagtatgattaccaaagtaccagaatagcatccaagtgaatattccactagctagtaggaaacgtgtctggagagaaacgttaaaacctctaaaatagatttgggagttactaatatatgaatgaaatgccctgcgtagatttaagaggtaggcagaaggggaattcacgaaggagattaggaatgaatggttggagataaagaagaaatctagaaaatacttatgttacaaaagccaaaggaggtaactcatatggtttcctgggccatattgtttccttacgtacaagacagactcaatccccatcctcagagagcttactatctatcagaaaagttagatgattaggtaaatagtcctaacaaaacctaatcagtattgtaatggggaaggtatggagcattcaactatagagagacatcaagtaagaccagaacaagaaggttccactggacttagtaataaggaggtggtgataatcactatgagagcaatttcttaggaacacatagaagaagcctgaaagcagacgcttagaaaataaatgtgcattaaggaaatgacaatagagtgcttctctttcagaaactgttcaacaagaaaggaatgaggggaaaattacttacatagctaattgtctgttgacaacttttataaggtagaaggataattacctggcatcatccatagacagactcattttaactttcataatttggagacaacattgttccttcctttctaaatcttatcctttcagattcttaaatgtgttcaatgctctgtagaaaacattccacagacaatatgagcctctctctttatatctctaatttgggcacttaattacatgcttctttgaactgctgagtattttcatgtgtaaatgtcctaacttctcttacaggaagaaagccccttacaagtcaacagtgtttggtatcatgttgttcaccttctagtgctttatttaaataaaaagtaatacagctgcacagagagctttcacagctttgagcagatgaggaagtgaagaacagaaggcttgtagagtagaaacatgaactttggaatcaaacaaatgtatttgaatcctggttccacccttcataaactaagcaaccccagtcaaattaatatatctatttgagactgaactttttcactgtacagagcacatagtaaaggctcgatatttactgaactaaattaaaaacacttgatataatatttatatctgcagagtagttgagaaaattaaataagataattatgttaagtgtttagatacaatatgtttcagattgacactatctaaggatctttctttcttgcagatttcattctctagacctgttacgaaagtgataaagaggacagggagcctagagagctacagagtttaatagaaagttcctggctcaaagctttactgggaatttagttttctaaaacattatcactagcacaacgttttttataaattgtggctttgaaaacctgtatcacaatcacctgggtgcttgatttaaaaaataataagttgccgggcatggtggctcatgcctgtaatcccagcactttaggaggccgaggtgggtggatcatctgaggtcgggagttcaagaccagcctgaccaacatggagaaaccccgtgtctctaccaaaaatacaaaattagccaggcatggtggcacattcctgtaatcccagctactcaggaaggctgaggcaggagaatcacttgaacccgggaggtggaggttgcggtgagtcaagatcatgccactgcactccagcctgggcaacaagagcgaaactcagtctaaaaaaatttaaaaataataaaaaataataaacaataaataaataaaacaagcaaacaaaaaattaaaaagtggtagattcctagagcccgctccagatcaatttgtaatgctgaagctcaagaatctgccattttatcaagggaatctaacatataagaatgcttcagaaccaccctctaaaagtcaaactcaccccaaatgtattttgccagttactgtgctccaaaaacaggaaacaagattagttttcagacttccctggatataggaattatttattatgatttccattcaggatgggctctgcagagtcatttctatctcaaggaagctataagttataatcttagtaaagtgaaaaattgagggacaggtaggaggattccagaactactcccttccagggttggagaaaatcaaggcatatctgaacactaccagaatgtccactcacctccattccctgtctcccacattcctcacacatacaagtgtcatcagaagtggacagatggacatgctaaggctgaattaaacccaaactgataccaacttagcagcggagtgaagctatttatccctcctcccttttttgggcaacaatagccatctaggctaaaggcttattttcttttccataaagagatggcaaaagcatacttctcctctgataaggctgtctgtggaagctggttagaacaagggacattctttttttctttttcttttttttttttcaagatggagtcgcgctctgctagaaaggcaccaactgcccaccagggcaagggcaaagccttcatgatccaaagcctcccattaggccccctctcatacagtttctaccctacaccttgctgcactggaaattatggttgcaataagagtttgggcagggtcaagttacatccaaaccatagcagagaccatgctaaactatatctataaaataaaagaaagatactacaatttaaaatgaaaagctagaaaaagggaacatctgaacagtattaccaaatcatttacaaatagatatgtaacaaaagaagagcagaaactatctgtgtcctataaatcaagattagaaattaaacaatcaaaataccaaatgttttaatccacaaaactgaaagtctttcctggaagacaagtgacattacatttcttcaatctatattcattcaaatatatgctaaaagtattatatttcaatagaaagggataattctgtcttccaagatataagatacaaacatgataaaaaagtttttaaaaaaagtccaacaagggcagaagcactagtgtagagagttgggaggataaaagggcaaagccagaggcaagtatgataggttcagatcagaaacagggctgtctatgaagtcatacctgggtgctcatgcacccaaatttaaagtgtgtagaacaaatagtccagggcccaataaaagcaagtcaaaaaacaagagctaagccagctgtatcaatcaccagtcataagaacagggtccggactgtgttcatcatttttggaggtcagggaattctgataagctgctgacagaaagtaagaattgttctctattttggcagctcacagtctacatctatgtacaaaagtaagtgaatgagagtaggtcagtatctcccacgcttagcagcggaaaccatcagactttcctcccaccgaccatcttgataatctgctggatttggctctttgccttgattccaagtgcttatttccctttccaggggaaatttaaattatatctgataagggccaacaagttcagagttgtatcaccctctctgagtaatatcagactactcctcagtgtcatgttaaactcaaattaaactggacagagtatttatggggacccaggccagctttacaagtgaaaaataggcccaaagaataaagtaattctcttcatgagatatttgcaaatcaaggtgaatacaatatgcttttctgtactctgaaaaatggtcttatattacatcaaattatgtcattctagtttatacctattattgtcagaagaagtttgtgtaattaagaaaggcaagctcacaactgaagtgattctaactttgacttcataagacgtgcagaccctggtatactcagggtgttttgagaaagatggggaaacagatgggttcaaaaagaaaaagacctcaataaaatcagaagaaacagaaaaaataatatcttgtcagattcttggcttagatggttacaaatctgccaaatgaagacaaagctgacctatatcataaatgggacaaaagtttaaaagtaagagcaaaagtcaggagtcaaaattattctagaagcagcacttgtgtgtaaattcaaaggtaatctgaaatagatcatcagttcccaaggaaaatgaataaagggaagccttgagtagtctcagcttaagtctaaaattcataggttacctaggtgtggtggttggcagatgaaggcaccaagaggtaggcagctattatccagagctttatcatgaggcaagaaatctagtcaatgggcaaccgagaaggtaggtaacaataagaccaacagcaagactgaaacaaaaccaagcaacaggtgtaaggctttttgtatcacattagacctagaattgagagctgagctaaaccagaaatcagagttgaaatgacactatcttccagaattagagaaactcagaagtgggaagcaaagcagatcatcactgcacccagatattttagcttctcccttctaggattcagaatctacaaagtggccgggagacacaaataaagctatttgtcagatccaagaaaaaaaagcattagggagttcagcagacctccaaggtccaagtaatccacaaagatgaagtcatctcactgtagagcaggggtcaggaaactatagctcaattgccaaattcagctcaccacctatttttgaacagcctgtactgagaattttttgttgttgttgttgttttttgtttttgtttttgttttttgagacggactctcgctctgtcgcccaggctggagtgaagcggcacaatctcggctcactacaagctccacctcccgggttcacgccattctcctgccttagcctcctgagtagctgggactacaggcgcccgccaccacgcccagctaattttttgcatttttagtagagacagggtttcaccatgttagccaggatggtctcgatctcctgacctcatgatccgcccgcctcagcctccaaaagtgctgggattttaggcatgagccaccatgcccggcctgaatgttttttacatcttgagatggattaaatgaaattcagattttagtgtccataagtaaaggtttattggaacatagccatacctattcatttatgaagtttctgtggctgtttttgtgctacaatgacaaagaggtagcactgccagcacagcccaaaatatttactattgggtgctttacagaaaagtttgtcaatccttgttccaggacagagctcccaagtgacagtgagagataaccaacctttctctttctttcctgactactgtagtttgataacttcatttgaaaagcagctttttgcttggaagggtagagtagtcaaataaagggctaccctagaataaggtttatccaaccttatctgaaaggctaggtaatccagcaaggagaaaaaaaaaaatccatgacatttattgatagtgctgttctgctttctggagtatcatcaaaatgctcccgaggaaggtaaggaagcagctagcagttttaggtgtctgccacataaaagagaccatgagcccctcacactcctgacaaagatgattcaaatgctgcagggtgtatgagaaacacatcaaagatcaccaaaagggtctgggccaagattccagccagcagaataggaatttcagaatacgataaggagatgttaaggaaggtcaggcagtaaaaagaggtttgctgactcatgtggtttgttgacttagcaagtcagggagaagtcaattgtttgctctcctgttttacagtctttaggtgtgggccagcccagggccattgatagtcattttagccagaaggaaagcaaaagcctgcagatgaacttaaacaaaacagctgtgccataagttaaaatttatgcttttctcttaatagaagtgtttgttcctcttcagataatctaaacttgaacttaaaaaaaatatatgtacccacacgttgtttaactcctatagcatgtatttattgagcgcagactctacggcaggtgcttttttaggtacaataataaacaagaaaagtccatgccctcatgaagttttacatactactgggtagaaaacaatcaaatcaacaagtaaatatacaaaatcttgttaagtgcatcagagataaagcaagaaggatgctagggagtgctgggtggggcatgggggaggaaggctgctctttcacacacagctgtcagggcaggcctccactttggatgagcaaaggcctgcaggaagtgagccagcatgcctccttgctgtatcctcagaaagaactccaggcaaaggcccagcaggaggatatcaggaacaggtgaagaaatgcaaggagcccagaggggttggagcagagcaactgagggggagagaagctaagatcagaagaacaataagctaagaagggagagagggtgttcattgtggaaggccttgcaagccttgcatgccatcccctcgttctctgagtgcagtgggaagccactgattagtttccgaggagaggaaagacatggtcagacttgcagtagccagagtaatcctgttaaaattaaatcggatattgtcacttcaccatttaaacattaaaaccttcccaaatgaaaaacaaataactgcatcataaacctccaacctatttattatctcaaaaaataatgttttctagtttaccgaaaaacctcatgatagccttacataattttttaaaaaatttcactggaaggtgttttgcagttgttacaccatagtaacacatcactgattcagattaattggggaaaagacccgtcaaaattagttaaaagactaaattattctattatatttaaatagctttcattacctttttgtgtgtgaaggaatcaggattgccaaggttgcctaataaaatctgttctgatgaatagatttataaggattgtaattagcatatgtcagcatcagactatgctaccttggctctgcttaccgtacaatttctatgcttcaatttaattagatacaatataaattgtttcaaaagcagtttattttctttaatagatttgtcctttacttaagaagatgcactgcctactttttttatgaaaaagaaaattgcatggccccagaagtaaatcaaataatgctggctatttatctttttgttgtaattgtaactcttactttaaatcactgagttcctcaatattagtactatggcattttggagcagataattcattattgtgaagggctcttctgtgcattgtaggatgcttagcagcctccacccaagagatgccagaatggcacccacaactgtgacagtcaaaaatgtttctacacattgtcaaatgtctccggaaggaagagagagtagagggggcaaaatcatcccaggttgaaaactgttaccttaaatgaatgatcctctgtctttctgtgggggaaaaatggttccatctcttttctctcatccatattatgaatatattcttagaaaatgaccagaagatgtaatttaattttgaatggcagatttatataagaaatatcaaaagaaaaggtcactggaataatcaacacatatgagaataacatttgaaaaccatgttttatcagagttctcttagagagttcctaacaaataagcttaaatgcacatttggcactacaacttttaaatgagaaattatttgggagaaggagattggcagaaggaaataatgaccttcaaaatagtaactcattatagctttaacaaaattaagactgtagttaaaatttatagtcttcctacttttctaagagtataaattgatataaccctatttaaaattggggtagttggattattattgtaaaaagaagcctatactgcatttttgtacatctcaaaatattttgttcccaaatataatttccttttattcatctagaataaaaatttagctgttttatatattaaatgttttaaaatatattcagaatgaaagtaatctaagaaaatggctgttgttattgctccttaaaagaagtcaaatttttacaaataagcattttcatcattctgtctatggcccccttggtaatatactgttgggcacgttcatatgctctcactatcccatacatgtagatgactcaaaacatatattcatactctctacagctctatgtggtatcccacatgcaagtctgatgggatatacacaaatgaaagtagttgagccaacaaaagatacatgtttgggaaaggcacaagggaccggtaagaagtgagctttactttagtggacagaatggggggaaaaagcaccctagaaataagtgctcaaccacagttaggtggtgatggagttgctacagacgttatgttgctttttcagcagatactttgagcacccaacttgactgctcttgactcagcagcattcagtcttagtctaagaaagatgatcacagtcacagccaaatatttccatcctgaagaggatgctcacatggtaagaagcttatatcttctgccaaaaagtgaaagatcaggggtttgggtagtggcatttgcgacttctagtcttccttttttgtccatgttcccccataatggaaatgttccaatccttaaaaaaataatgttttcaaatcagtgaaatttctaatttctcccaatgttttttcctcctttgttgcctattgtcagttaaagggatcaacatctctctagtcacgcaaactagaaacctcaaagaaacctcttagcccatctgccacaagttaattgttgctcaagatctgattccacagcaacatctttggtagctttgccctccttgccatccctgatcccattgctatggttgaggaactcatcatgccttacacctacattcactccagagactttcagatgctctttcaacaccaatttttcctgacaccacataattatgcttattactactaaatctgtcctaaaaaactgatataatcatgagtcgactaaataaatcttaattaattctttattttctccagattaaaaatcaaattccttcccagactctccattattattctcaatcaacttttatttctgacacacatatataataacgccaatcattacaggttttcagtcattcaagtgcgacaaagacttttaactctattttttcttttgtgggcctgtctttctataatgctcttcagtccaatccctacaactttatggcaaaattctgttcaccatccaatatatttcagttaagattcttagcttgtatgttagtgctcccatggcaccttattagtagtttcattatagtatataatcacactatatttcagttgcatacataattatttgtcctttaaaattgtgaactctttttggtcaaggaatatgtctcattcatctttgtagtctaccagtactttagctacaacagagttagcgctattcaactcaatcaagcttaaccattagaaatggaagacaactggccaggcgtggtggctcatgcctgtaatcccagtactttgggaggccgaggtgggcagatcacctgagatcaggagtttgagaccagcctggccaacatggcgaaaccctgtccctactaaaaatacaaaaattagctgtgtgtggtggcacgtgcctgtaatcccagctactcgggaggctgaggcaggagaatagcttgaatgaacccaggaggcagaggttgcagtgagccaagatcgtgccactgccctccagccagagtgacagagtgagacttcaactcaaacaaagaaataggagacaacttccaaattatgtatagttttatttttcttatctttcattttacctttccccagattaatataatttcctttaattccaatatcaaatgtggacataaaactaatctaatgattgtttaagaaattagacggctgggtgtggtggctcatgcctgtaatcccagcactttgggaggctgaggtgggtggatcacgaggtcaggagttcgagaccagcctggccaacatggtgaaaccccatctctactaaaaatacaaaaatagccaggcatggtggtgcatgcctgtaatcccagctgctcgggaggctgaggcaagagaatagcttgaacctgggaggcagaggttgcagtgagccgagatcgtgacactgcactctagcctggatgacaagagtgaaactccatctcaaaaaaaaaaaaaaagaaattagagaaaaatataatgggtggaaacaaattaaattaacatttcatttattaaatttttcaaaagatttcgaaaaaacatttccagatctaatcaaaatataatgggatgttttatcacttcaatttgaaagtgagcattttgctctaaatgaaaaatagataagacaaagcatagcatgttttttgacaaatatccaacacaaattcatgtgaatatgcaaaactgcctatgcctatggaaataataattatggatgtctcaaggaaagtgtttacaaaataatgagattctgcacatgtattagtaagtaatatcattttctgaacagaacaagtgaaagaaaagacatcctacacttcaaaataatgctcacgaaacatactgttatcttctttggtgaacaacttggtatgctacaaaaatttttcctcttattctatgcatttggttaaaacacacaatagcccatcactaaaaactgaaagtaatctttggagactgaattataaaaactactgaacttcaacagtgtgagcaaaatcttctgtcatttcacaggatatgttataaattactactgaagtgaaaaacgtgaaagaatattttaagagaattcaagtcatatcactgtttactttccttcaacatagaccattagacttctaaactaaataataaaattaacaagttatttcaaacaataacctgacatgatcataaatccatggtgagctcattagagctagatatgattttgttaaactgatgtactataaatcaaattcagagagcaaacacttctacctatggagcatttttaaagaaaacaaattcctgtgttcaaatgtgtaaataataagaatatgaagctaccttttctactgtggcaaattcctaccaaagtaaactgcagctaggaaaaaaagtgacaaaaagaaatgctataattgaactctaaagtacactttcaaaagttatctcaaacccctaaattggtattcctctgtatactctaagtaagttataagcaatgattgttttaaaaaaattgagggcttatctgatgtaagaattcatcatcacattactatctggtcctgatttctttttctacaatgtaaagcagagttttaaaatgttttgtcatacattgtacaaattatattaattactattgtttccttagccttcattgttttctgacaattattttattcattttcatgatcagtaagagagaaaagtaaaagactgtcttgtacagcgataataattaattcagggccagatgtgaccacctaaaagatgtaaaagataagccagattttttaccaagatactaaaaattgtcattaaaatataattagttctataatacctatattttccataagcatttgaataataatgtcatgctaatatttccctctggaacaaggactaataataaatactaaaattagataatttaagcaaggattttttaatcaatgtttataaaattttaaaattattttctgcacttattaaagaatagtatgactaattcagagttatacagcagcgatacagtgcagtattgaagagcacagattgtcatgccagaatatgcaggtttggattccaactccaccatttactaactgcctgatcttgattaaattgtgtaacctctttaggctttagattccttgcctgtaaaatggagacaagaatgatatttgtttgttatgagaattaaaataactaatgcatggaaaacactttagaccagagcctgataacacagttaatagttttatcattagttctagtggtgaagttctttggaattccaatctaatttttttttctaattcggcctacttcacatcttaatacaagtacttaccataggcaagtttattatcaatgctactggaataaagggaaaagaggaatgatttttaagtgaacaaaaagtgttatcacttccccaactatcttctgggctccctagcgacatgagttattcttccccatggtgagaaaagggagtggaggtgggattctgcacaactcaagccccaacaaaacaaagtactcctcatgtttgggattatttttctttcaaatttcagtttagggccgacttctgagctgaagaaattactataaacttccaataccctgttaggggattctaccctgaatgtagtggagacagggcaagatggaaatcaaataggcttagtagaataaatcagaactatttcagtaaatattatgcattgatagatcaaagtgtaatctatgtactataagtaactctaaaaatgaaactatccttcatttgtaacagaaggactctttttctccagtttcatgtataaatctacctacttctaaattaacttagtgaagtggctttttcattgatacatggaaaaaaatattgacaaagaaaccagtaacaaatgtactcagattcaaattcaccaatggaaaagattttgaagcattatcttgaatatacaatttttatattcaaattttgtctttttagtaaaataagcatttacttaaaaagacgataaatttaactttctaccaagaattataaagaatacataactggcaccatattgtataaacaaaggaaaaaaagctaaaacagataattagaattttttgaacatatttatttgaagagaaaaatatatcgctgtgctagttctcacatttattaaaagagaataatcaattttgcagactgttatatattctaagaagtaatttggccttctcaccaaataatcataataaagagctgagatttaatcaaataaggtaaatataaaataagataatttgctttttgctactaaatagtattaaaatacttttaatctgttagagagtcactagagaaagtagttaacaagaaaaattacttactcttgtttgattacaaactactctaatttttaggcagaaccatcaataagggagaggtcacagaaaaaaactgcgtcgctttcttagactgttgctcaacttctgatgccattgaaaaagacttttaattgtcattcataaaactattaactttgttttctcagtagatcaattaacatttactctgcattaactctactcttctttcctatgtgattttgtttccaagggttcaaaaactggaatattggtacaataaacacataaggcaatttactcatttataagtaaatactgggtatatttaagagaaatatttagtaagcttaacctgtacaatgtgattgtatgggttccttacagaacctgaggaacctagaagacaactgcatgcagagaaggataaaaaggcaaaatttatggttaaaatcatctgctaaagacaaaagaacaaacaaaaaatgacagttaatttatttcataaaaacttgaggaatggtatttgagcgaaaaatttcttgtgaaaactagggagatctaagattgtggttaaaatattacttttacaggatgacatcatatctccaaagtcaccaaaaagaagaaacactacgtgctaaacgaagtaatacacagattgtgtgtttttcatctctttttagatctgggtatgatcctgggcatattacttcactacttaaaccttcaatttgtagaatctaggttggtcttaggtaattcctaagagctcttccagttttaaattttaggaaaagaaaattatatagatcctaaatgccattattactcataggaatgggaaacatgcttttatagaaagtaaaggctcttatatattctttaatctccacctgtcagcacatgaaattttatgtactgttatatatgtgaaacaataaatcatctttaagcagagcatctttcttaaacacactggttctataccagggctaatatatatggtaggtagctgtaacttatgctgtctaaaatgtaaaggctttctcttcctgtattaatattgaaagttttttagttaatgtttatcttatgtgaggggaggaatcgatttgaaccaaaaacaacctcaaaactctcctcaaaagggaacaaaaacattgctttttcaatcttgctgcttcaagttaggttccctaaacatcgccatctctttacagaagcaatcaacaatttaggtctggcaatatcattaaagaactgtgactttggacaaatcatatacatttggaaaattttagctctcctaaatattaaaacaaaaaaattagagtttatgctagataatgtataggatctgctgttgcaatattacaattatctgattatgtgtaatacatatcatatattatatactatatacaacatatatatcatatagaatatatgatatttgaaagtttctgaaatatatttccccattgttgaatacgcacatctcagaaagacactactaaatgctaagaaatgaattaattagttactacttggtaagcagtaccccataataatgtactcaactgtttatttaaattaatcgtcttacaaaatatattaactcctcaccaaagtaagatgcattacctcattctattgattcttggaaggaaataaaaaaggcaaatattttctctgctttacaaagagaggaactagaacttggtgagtggatgggattgtataagcagatcacagagcaggccagcatcagaaggagaataaactgtggcccagtgaatctatagagctttccattaacactatgcctcttattatctgttacactttgtagtgtatgagtgagtgtgtttatgcattttggggtagtgggtaggaaagccagtagagaggaggtaatcattgagctatgacgtgatctagaaaggttaattcattccctgcactaggggttccagggtatcactaaagactagattcaaaaggttacatagctcttccatttgctctctagctgctgaagttcattaagccatattataatgggaaacgcttaccttataaagatagtgttaatctacaaatataaatgttgcttcaaactttcaaaaaattaccttgctctttctaaagtctacacaaaatgtaaacacaagtctttagggaatgggacaacccggcaacagaattcatcatcccatgaactgcaaagttgtctcaaatattgatcttttcccaaataaaggcccatacatgaatatcttctctcttgggacaatcagataagtcagatcaaagttctcaatattttttcttttcctttcctggcccagctgtttttggactcttatggttgaattaaatgaatttttttcctgttttcctattttctctttaccattgtttgttatctgagcttcaccataagtttaaataaattcctcaaatcaaagaccaagaataaaaacagtatgaatatcaaataattttgagaatttggctatcacctcaaatattttatttcaatacctgaaaggtatttttcttttacttatttgatacatatgttgacatatagctcagaatttctggcttacaacaaatttgttaattcctcaaagaaaaataagccaattttattaaaataaaaggtgaacagaatgatcaaacattaactaagctaagcacaaagtaaggtgttctcctcaaattgcttcaacatcttaatgtcagctataatctttccagtttgaggttcaaacaaaaattgcctggctagagcacagcaaagatggagcttctttaaaaacgggctgtactctacaatttgttgagccaaaagatgcatggtgctttcttggatcatgtggaccacaccaaagagagaaccaacctggagctgtttaaattcttatccaagaagatgtagttcaggggtactaggctgataagactagattctgatatcctgactgaacactattatcactgattgtgctcatgtaactaggaaaccattttacacatagcagacacagcaaagcagattatgatacacttttgcttaaaatcccactattggtttcccattgcatgtagaatgaaacccaaactcccaaatctggttaacgaaaccctacttggttaaatatctacctgccctgttcagtcactccctttcccccatggcagtccatctactggtttccctacttttcccctaacaaggagggctctctgtgcctgaaactcttttctctttttcatgatggcttccacctgtcatttagatatcagtttaaatgtgacctccatagatatatcttgcctgacaaaacgctctaaagcagtgaccaagactctctccctaaccaaacatcaggcaggttcctcttttcaactagatctcatccttggacaatgtccctaaccttcctaagccagcctaaatgaagaatcctacgaagtgatttcccacctttgatatctcatcaaggtcttcatcctctacccttaatgtctaagtccttggcctgcctttagcaagaatcttgttagtccagttcagcaactccctatccttgatgtctcctcttaaaaatcttccatccactgaccccctcactctgctccttgactataaatccccagctgtcattgctgtgtttggaatgaagttcagttctttcctcaattgcaatagtacaaaataaaatctgtatcggctttaactggtgtctggctctgtttgtttttgatagtagccacccggtcccctggtatcaaattaccctattttaattctctgcatagaacaaatccttacgacattattatggtgttttgtttatacactaggatgcaaagctttgggaaaagagggccattgtctctctcaatcactgtttcatcaccagtgcatatagcctagaacaaagcttggcaatggctacacactcaagaaattttgttgggtgagaccattttcatgatatatctaaaggggtatgaaaatgcacacaagagaatgctgaaaattagcatatatatataagattataaaaaggcaaaaatgaataaatcaaatattaaaagttgagccctcaggtttcttctttatacaatgttgtattttccaaattttccactaacagtattacttttaaggtcagaaaaacataaaaaataacacatgaaaaaaagtagtttaatgaatcaccatttttagttggtttaaaatgtgtttctttggaagaaaccttttgcttgctgcaagttttcaagattattgattctgtgccaagagaaagacacattcaaatataaaaatgaaacaagcacattttcacaggggaaaaaatggtcaaaaatagttatttccttccttaaagttctaaagcctagctgattttaaaaccaaggaaataataaaatagagaacagggagaagaggataagagtctgatattacttagatatcatattacctatgtcagggaaatcaagagcaaatgctgttttccctgtgtaatatgattcagtcatgattgagtactagtgattcatgtggtgctgttaactagtgcgatgatcgacaggaactgcagtactttccttacaccctgggtcaactactctccaatgcatttgcagatgtccacttatggcatctgtctttaaaacactcctcctttgttggctgttgcttactattttatgacagtcactgttgttattgatgttttaaaatcgttctttacatgaataaacacaacactgtcagattacatgtcatggagattcatcaattaaggtaagataaaatgagaaagaactcatctcctatttctctcattagataaaaagctttggtggaatctactgaccttagggcccttatgcaggctattggttccctctgcctacaatgtttttcgtttgtttgcttgtttgtttttcccccagagagccaaatgacttccttcctcccttcttttaggtctgcattcaaatgtatttcaccttctctatgaaatggtcctgaccaactatttaaaactggaataccccaacacccagtatttccctctctgcttcctatttttcctcaacaattatcaccatctaatatccaatgctttgtttactgcctgtctcccccaaaactgcaagctccatgagggcagggatattggtctgttttgttcctactatacacctagaaatgtaacttgttgagtgagtaaatgatacaggtgaatttgccagtgttacaatttttgagattatgtctcataaatttaatccatctatgacttatacactgagataaaggatcactcgaaatctctcttgtggttagaaatgggtcctagggttcaaggacctagaattgtcacagttccttttgtactcctgaaatcttaaaaggttaaagaaaacctccagtgaggtaaccaaggaattatgacatttggctgttatggatcctcgcaaaaagatgtacactgtgtcagaaggtgttgacaatgctatctaggacacaaaagtttagaactttccccagcattctttctctttttataagtttagtctgtatgtagtgtcaaaatgaaaagagttcttgttttagcttggcagtttttcgagtgtttgactttggtatcctagaggaaatggaggaaactagtttcattatccacaaaaattgagtttcataggaggacctgatacaaaccaaaccaaaccaaaacaaacaaataacaactttctgcacaggaattgcaacttcactaaacaaagatttgattttatcttaaacctgagcaagagaagtaatctttgaactatagtggttcattgcgtaatttctctttagccaatgttgtgggcaaatgatgtcctccccaaattcctatgttgatatgctaatcctgatagcacacttcagaatgtgactgtattatttgcatatagagtgtctaaaggggtaattaggtgagaatgaggttatcagtgtgggccctaatccaatatgactggtgtccttacaagaagaaatgaggacgcagacattatacagagggaagaccatgtgaagacacagtgagacgacagccacctacttgcttaggaaggaggtctcagaagaaaccaaacctgacaacaccttcatcttagatttctggcttccagagctatgagaaaataaatttctgttgcttaagccacccagtctgtggtactctcttactggcagtcttagcaaaccaatacagccaaacaagaaatgccataaatttttgtcagagtaaaatgcttctagagaggtagatttatatgtcagagttgttttgttctctcctcaaaccagaaggttccttttaatcagctggcagtatgttttgttcctactatacacctagaaatgtaacttgttgagtgagtgaatgatataggtgaatttgccagtgttacaattttttttacccatagtatccattcatttaagaccctaagatgcacccactaagtgcagaatactaaaaacatcaaagcaggaatagaaattgaatgcccctacacataaaattaaaacacctgtaaacttttcagtgaaagattttgcaaattctacatcactgttaccccttttctcactgcttctagatcagaaatacttaggttaacaataaaattgagggagctgggacagtaacatttttccaaaataatcaaacctattatcacagaatccagtttacacatatttctgaatttactttttctttcctgtgtttttcttgtttcttatattcatcacattttaaaaattttgaaaagtcatgcaattttataattcatgagggataaatattctaaagtccttttactatttctagaatcaaatcaataactataaggtaaacttttttgtttttggagacaaggtctcattttgtcacccaggctgtctgaagtgcatggctcactgcagcctcaacctcctgggctcaagcaatcctcccaccttagcctctctagtacctgggaccatacatgcacactaccacatccagctaatttttttaatagtttgtagagatatggtcttgccatattgcccaggctggtctcaaactcctaggttcaagcgatccttctgcctcacccctccaaagtgctgggattataggcgtaaaccaccgcacctggcctaaagtaaactttctacaggatatatggaatgtaatttagctgagtaaagtgatgacataaatcctgtctttccatacttcagcagcagtagctgaacaattctttttttttttttttttttgagacagagtctcgctctctcgtcccaggctggagtgcagtggcgcaatctcagctcactgcaagctccgcctcccgggttcaagccattctctggcctcagcctcccgagtagctgggactacaggcgcccgccaccacgcccggataatttttttgtatttttagtagagacggggtttcatgtgttagccaggatggtctccatctcctgacctcgtgatccacccgcctcggcctcccaaagtgctgggattacaggcatgagccaccgcgcccggcctgtagctgaacaattcttaaagacacataaaagcactattcaaatgagaccttatattattttttgaagtgtttatacataatcacaaccttttgaaaaactatatatataacttttcaaaaaattgttatacttgtttcatttttaccttcacaactattttcccaattaggtaaaggattattgttttcattatacgactctacagaaaggacattgaactcattaacatagcagactccaaattatgtggttaaaataaagctaatataaccagggattacctaaatttatttatttattctttaaattacactcaggttttccactggttggtacacaactttcagcacaacagaaaacatacactattaattaatttagtatctttgtttccacaaacttaatttttcacatttctacttcaaagattgcatcaaaaaacaaacagcaaacacaggaaaactttgaggtatcaaatgtaaccaagattgaaagttaggaacctattttttaaaagttataaatattctagattataaaattagcatttttattgtggtaaataacataaaattttaaattaacatttaaaaaacattaaaaatacgttctcaccaatattagggtgcttcaaaagacggcagattctagcttctctttctagtttctgatgatctgttaaaaaaaaaaacagaataaggcaaaaataaagcaaaaaataataaaacacaataaacagcataacaaaatgacaaaaggcctttgcatttacttatcctttgatttcattttgaaacaatgataattcaaatttagaattaagtgaatagcacatagttcaacaatctaattttatttttcactgacttgatgcttgacagagtgcagtatagaacagtgctagatttagacttcgggaaaatagtggaaattgcacaaaacaatactattctttctcatctttacatcaagtatatattattgtaataagttaaataacccagtatagacataccaatttagagcagaggatgcatatatggaaattgaattgccaatggaataagtgctaagtcaggtaattatattttatccctaatggagaatgttctctgttcagtcatatgttctgttaaccattctccttacaattgttggctcaacttcctaggtatatgatgctcttcctaatatcaaagatttccaaaaatccctaattgcttgctcatctttacctttctatgtttccctaaccatttctttgaagaaacatgaaacactatagacttgtgttttaagaattatcttaatattcttctttgattttttggtggaggtacctataaacataaatataaccaaaatgactcatcaaaacacaaaataaatcatagagagaagacaaaaatatggtagaaacacatgttgctgataagggtagcagtgtatagtggtcattagttgaaaacttatacacaaaatatctgatttaaatcttacaaccaccatcttatattggcaatattatccctattttaaaatacaaatgccagtagtttaacaccactgcctcgattaatgcaaagcctccagcaatttcatccactatttcttttgcatttatgatgcaacacatgtcaacacatataaaaatgtcaacacttctttaaataaaaggaaaataatgttttagttttagtttggaaatagttttgaccttgaagatcccctaagagagtttctggcactccctgggtctgcagacacactctgaaaaccactcgtctgtgctataatgaactgttgtatataatgtatataatgtagattttttttggccatttagaaaaatattttaaacacgtatagtgctattaataactcaaagtgtcaaaaaacagtgtcttaataaatcagcccagcattagataggctctaacagtgtatctccattatatctggattcccaaatacaaagatagatactctctggacctaccattatctaaaattatacctacttcaaataaatgtaaattcttcaaactccctatctttttaacaagtacttattcttaagacaagctacttccaacttatttagaagtatgcaagcaaacacaaaaagtaaaggtagattttgaaaatgcctctaacagcaataccataaatattgcaaagtgttatacctaaagtatatgaaagaggctgggcacagtagctcacccctgtaatccccgcactttggtaggctgaggcgggtggattgcttgaggccaggagttcaagacaagcctggccaacatggcaaaatctcatctctaccaaaaaaaacacaaaaattagccgggtgtggtggttggtgcctgtaatcccagctactcaggaggctgaggcagaagaatcacttgaacccgggagatggatgttgcagtgtgctaagaacgtgccgctgcactccagcctgggtgacagcgggaggctctgtctaaaaataataataataataataataataataataaagtacatgaaagacatatacttaaacagagatttgaattttgttatggagacagggatatgaaaatatatgtgctgaactatgtgatttttttatatatataaatcatctgaaaaatatataattacattaaaataaagaataaaaaggaagcaaaagacctttacagacagtaagttctacagagtttttgctatagagataaacataactataaaaaaattatcgtatgagctgaactgttgtttccccataaaattcatatgaagccatcctaatctccagttcccacagaatgtgactgtatttggagatggaatgtttaaagaggtgactgagttaaaatgaggtcattattgtgggctctaatctaatatgactggtgtccatatatgaaaaggggactagtgcactgacacacacagaaggaagatcacgtgaagagacgaggataagacaggcatctacaaggccaaggagaaaagcctcagaagaaatcaacgcttctgacaccttcatcttagacttctgagcctccagaattgtgagaaaataaatttctcacaattggctatttaagccacctagtctgttgtactttgttgtggtagccctatcaaactaatacatctaatgtatcagttttctattgctatgtgtccaacacctcaaacttagaagcttaaaacaatgcatatgtataatctcacagtttctgtgggtcaggaacctgggcatatcttaactgagccctttgctttagggtctctcaccaggctgcaatcaaggtgtcagccacggctggggtctcatctgaaatcttgactgaggaaggatctgcttccaagctggcatagttgttggcagtactcagttcctacaggacttgttgaggtaagggtctgagttcctagctagctgttggctggaggatgccctcagttccttgcatgtgccaatatggcaacatgtttcatcaaagtcaccaaagggaagagtatggtaagcaaaagggcaggtcattatcttatttagcctaatcacagaagtgatatcccatcatgttttccatattcaattggttagaaaaaaaaacctaggctggcccaatttcaatgtacaagggcatgaacaacaggaggcaggattattagggcatcttagaatttgtctgccacagtagatttttttttttttttgagacagagttttgctcttgtcaaccaggcaggagtgcaatggcacaatcttggttcactgcaacctccaccccccgggttcaagcaattctcctgcctcagcctcccaagtagctggcattgcaggcacctgccaccatgcccagctaatttttgtatttttggtagagatgtggtttcaccatgttggccaggctggtttcaaactcctgacctcaggtgatccaccctcctcagcctcccaaagtgctgggattatgggcatgagccaccgtgcccagcccacagtagactttataacaatagtactgatgggctttctcttgaaaagcagcttcatttacttttcctccatataatcacataacttagtgatcttctatgaatcataggcattctgcactctcccactgggacatgttttgacatcccaaacatgatgatataagtaaattctagtttccattaaaactagaaattaacaataatgaaaatgcatatcacctggtatgtttcacatttaacatcaagtccacaacctgacttttagagagagtaggcaggtgaggagtgattaaatacctactacagtattaccaaaaagcacatttctgtatttatcctgctacagagatggattacttttaaagtctcctttacttttaattctgtcagcaacaaaaactacatatgctacctcatcattcccagctctgacaactacagtggcaagcagtaaagacagattataaaaggcaagacagccataatactgtttggcaccatttgaagattttcttttattatccacaggccctgaagccagtgtggaaccagccttatttatcatttaatatttattaaagtccttgaactataatagtttggccttattattcctttgaagctcaagtccatactcttatatgaatcaaaatataactcttcaggctgtaatcttgtcaggtctgataaggtacaaactgttagtaatatatggttgaagacctgccatataaacaatgccttaaggaaaatacatcatcatttggttttgacatgaagtcagcgggggaataatattaccagtagaaagacttttggattttaaaacatttctcaagaattttggtgaaatgttgttataacattgcttcccagctaagatatattttaacttacaaaatattttatttcaaatgaggtggaaaatgtgaattcagacctaatgaagtaaatccttgactcctgttccaaatcaaattttaatctttatgcaaaagaataatcctgatcacaaatgcaaattaaagtgctagccctgattcactttcactcaacgatagaaatatcactaaagctacataaagcaacaatatatctactcaggcaatatcagagaataagctcttatcaataagcaaatttcaaaagtacttatttactcctccaaatacccaagcattaaaatattaaccttgttggggggttgggggaagatctaacagtcattgctttcttacatgaatgacatatataaaagaatttcatctttcttgacaccactgagtcctcattattagcattaattattactctcctgtaatccagtgaagtcctcagaggctacagaggtgtgaaaacccacaggtacctgcaccacctaccaaatgccaagggagggatttgggcaaaaggaggggttgccttctgtcataattggtcagttactgcccctcccaacaaatacacacacatgcatgcacacacacgcacgcatgcacacacacgcacacgcaggcacacacacatataagcataaaacctaaggaaggcttgaatttgccatggccgagaaggtttaattcttctactccccttccccacaaagagaatcccactcccaaaataatcttatatcaaaattacagaggagttgcccatgggagcatgaaaaatggaatgtttaaaatccagctctatcactaatttttaccttgctggcctttcggcttgtcagcttaagctgctgagctgctgagctgctgtgttccctattcttatctctttagtcctgacctttcctggccttatgctccagtttgagatcaatgcctcagatctgtttttgagggcaggttaattttgcctccctggcttccttactacagccaacccaactcgattttgaaatttttcacatttgtttcatttccaagaaactacagcctcgagtaagagacattctacttgcccctctggaagaaacctggctggctactcattctcagaataggggaagataatactaaatgtacctaaactatttgaagttttatactgttgcatctgcttattacatttttttaaaaaatctcttcatgagttattgctgtcagctgttagtgctgtgaatggctccagtacataaaacagtttcaggggcacataacaggccttaaataaatgtttgttgactgaataaatgaatgaaggatggatgccccttcttttttcacaattgctgtgaacggagaaatagagaaaacaaaagcttaaaaatataatcataaataagctggaagtgagaacctagagatcctctcttaaagaaagatgcactttttagtgcatggattccggagcactataatgtagctactcagaggccttcttcctggaggttttggaattacacagtgaatgcatttttcttgttagagaaattatgtctcactgaatgaggcatttctctagaaagaatatagaatctatccatttaagtaggtcacatttaagaacagactgcaaggtagaaggggctaaggaaagggccatttgactacaaaacctgaacaggatgtatatgaatttaaagctgtcatatccatttaacaaaaagttttaaaaattcataattaaatattacaaaactatgctatgtcattgtgtcataaatttgaatttttaactatttgacctagaatctttctgacattagggaccagtccttctgctgcccactatgccttggaagcatcagtaagatcctacaactatataggatgattgttcttcttttcatggcaaagtagaattagatatagatgctgaaaattcctacatcttaattttgaatgaaagtttctatatcttaatttagaagtgaaactttttgaaagtctattctgtgctggaagctcatacaaatgtagattatgaattatgatgtgagtccaaccttgattctatatggcctggaaaccatggcttccttgtggagaagctcaaccccaacatttgaaaaaaaaaattacgtgaaaaaagaaccaagcctctacttcattttaccttcattctgcagtttcatctacggaggaaaatggaattttcaactgactacagaggaataaaaacccataacgaaggtccctaattttgtagaacactagacacactgtaagagacaagccagagaaatggaaagacctctggcttcagagtgaagcagacaagaattgctatcctggttctaccactaactactagctaggtgtccaagttacttgacctttccaaagctccttccataacatgggcataaaatacctagcaccaggcactgtatctggaacaaaagaggtcctcaaaaaattatagtgtcaacactattatcattattattgctaaaaatgtgtccaactttaaaagaactaaattcctaaaagctacattaaaaattatattaattccataaaaattatttattttacatgtatcctattataaaaataactgtttttcataaaatcatatgattatgccctccaggccaccgataacagaaatagtgggagaaccactggtatctatggtcagaaagagacaaactgaatacagtaaaatacggacaaaaactcacaattattcagttttatagtatatgctaaacatctcaaaaataatatagaaaaaactattatttgtctgagtgtaaaatttgtaaataaataaaattgttcggttttatctataaacttactatattcttttattcatccattttgcatatctgaaacatctcttctgattaatagtttatcataaaattgtttaagagggagctgctgtataatatatttattctctttcacaggactgtaaaggaataaatattgatatttgatggcaccattcttatgttgtcctacagaagaaattattttccctcttccacaacaataatggcatctattcagagatataacattatatatgttatttaaaaatgctttacacaaaattatgaaaatgtaaagcaaaatctacattttatagggctcttgttcagttgcaatttaagtgaagatacaacctattgtagtccttttaaaattataaactatagtgaatcctaatttatataaaatattttcatataaatgtttatttaatgtctgattatataaactatctacatagctattaagaaggagatgggcatactctgctaagacctaatagaagtttcaagagagcctcttactaagccttatactacttctaggtgatgggctaaggggaatctgaattgagcttttatcccttgggaaggggaaaagtgggagcataattgtgtagaacaggtacactggaggaggtatagtattgaatggagactgttggtggactgtagatttcctttggaagatcaaggaaggagatgggcaggaaactctgattatacccttcgtagctctacctgacattagcgatctcccctcagttttcataccttctgtgatggtgttgctgtcttcctttcacgagagtgcctctgtctgtctgtctgtgtgtctgtcattctgttaacatggctatatcactcactgcatgttccaagatatgaaacatgtcttatgaaggtcaccagaggatttaggcaggaggagtaaaccaggaagcataagaagaggagagtggtatgcagaatggccagatagccaggacatgtaccttcaggagaaagaggatccaagcagtactcagtaggtcagagtcaagacctgtccaaaggaggaaatcaaaacttccagatggcattaggacacatggtatcagacagagttcacacagaacagatgaccatctgtcaacagtaccatttaaaactattatggctgggtgtggtggctcacgtctgtaatcccagcaatttgggagacccaggtgggcagatcacaaggtcaggagttcgtgaccagcctggccaacatggtgatacaccgtctgtactacaaaaaatacaaaaaatagctgggcatggtagcgtgggcctgtactcccagctactctggaggctgaggcaggagaatcgcttcaacccaggaggcggaagttgcagtgagccaagattgtgccagtgcattccagcctggctgacagagcaagactctgtctcaaaaaataaataaataaacaaacaaataaataaataaataaaaaactatgatgtttcaactgattgttaatattgtaagtaacaagcccttatataaaccacaagttataaggatattagttggtgcatgttaagaattaaagaggtttaaatttgtctatatctttattttaattgtatatcaataatttaattcatataaaattattccaattatactattatagaggactgatgagataaattttgtataatatattaactctaccctcagtctacaatcaaatagtactttccttagatgtaattttgcttgtgagaaatttgctgcacaattccattttgacttttaggcataatagagctaagtcacttgagacactttgtattaaaatccttcaagctttggctatctagagattagaaggacccagaatggaaacaaggcatactaaagataaacacatctctactaaaaatacaaaaaaaaaaaaaaattagccgggcacagtggtgggcgcctgttgtcctggctactcgggaggctgaggcaggagaatggcatgaacctgggaggcagagcttgcagtgagccaagatcgcgccactgcactccagcctgggcaacagagcgagactccgtctcaaaaaaaaaaagataaacacaatccacccttaaccatctttttccagtggccccaatgatttttacaggcagttgtacagtaacacaagagaacacttacttcagggattttgtttttctttttttgttttcttattgtggtatgataaacatattttgttattcttaagcatttttcctaagaattaagtacacgaatttatacaaaaagtgaaaagtataaaatatttatatggttttccacaggaaaattttccttaggtagtttaatactaacacattaaaaatagagataaaagaataactttggataacaatttagaagaataaagggaatgaaatgtaaaagaacacagattttttatggttcctttaaagcatctggaacatgctgttattcatttttctgtgactgagttctcctgagaggtaactgtgaagctaaagtagcttaggcatctgggcccttcatatgcacagactcctgaaaggaccttagcaatgtttacagactcatatgttttcataaaagttgcaaaacatgatatcttaacagtaatcagttatgatcactatttctttccactctcctttttcctccatcgcacttctctttgtgttgggcgacactggagcaagcatgaacatttttgagatctaacaaagggaaagttgagctgcactgaacatacatgtagtttaggtttaataaaacatatttacctggtttgcagtcacttctatgttgaggtatgttattgccagccatcccaatgtagggatgttttggaaatacacccacctcccagtctgccatgagataacgatgttgacacaccagaggtggtatcagcatatgaacctgaactacagatcaccctacaagtgtgtgaacaaaggaggaggaaaaatgtttttgttatttttctggaatttgttattctttgtagtatctgtcagctttttaaaatttgtattcttatgactatttcatcctaaatatatattcacttttgagtttaattttttatttgtaatcttttccttaggaagaacctcccagattgcatacatgtgaggtgctgctaagtgtggatgcatgttccttgttatgcttatgaaaaaaagtagaagatgagaatgtattgtttaaattctaaacacaaaaaagacttgcatattaaaatacctcagataatttataatattaactttcttctttaagtgaatagaatctcatttatactgctaaaactagtcattaaaatcccatacatatcttatattacattagtcatgagtgacccgccatagtaaaatgatcactaagttgaaagtcaaggtaaagaaattggcttccagtacagactctgccaagaatgacaaaaaagcaaatcttatacatgtgtaaaggtatatttattcctctctatcctattaagatactgtaagtttgagatactatgtatttatttttaagggaaaaagtccttatatcagacatgctacttaacatatttgtaattaatattttattaagcaaacacaagggaactgctagctgttttggaagatgaagtaagatgtttcggtttaagtacttgcaaactaataattaaactagcaattataagaatatcctttgaattgaaaaaagaaaatgaagttatcattgattgaactacaatccccaagttaaaaaatgtaagacacttaaaatcttgcatctatatattttaattctattaattgaattaatttaattaattaattaaaaataaaattaatttaattctatattctttgtttaccacatttgtgaatgctttcatttcctatacatacacacacacaaacacacacataaatgaggtttaatgcagccacctaaatgaaaaaaaatactactgagtcaagatgtttaaaatgaaattgtgtatcccatgtacctcaaaaatatgtaaaactatgacatatcaattaaaaaatataaaacaaatgaaattttccgttttagctgaaaccttgaaggctaaaaacaaaataattatcagatacaggtgccaaaccagaacttgccaagggttcatttgaagccattctgtcatcatgagcccactgtttgcttttggctctacaagagaaggtaatgagacccccagagaggactactcaggatagagtggttagaacattctgtaccacctcctacttcacaccacaaaagagcttactcaagggtaccaaattggaagggaatgagtgtctctgagagaaatatttgaaaaaaatgcatctcctggagttagagaaaaataactactacctattttaaatctgactttaaaggcaggaaattgtggcttgctaactgtcctggaattgcaaagcctagaggactccattgtgatcaggctatgcttccaacaattgcaagaaaattctcatggacaggatacaggcccacaggaggaatgatctcacaagggacaatgcccaaaaggaccacctggcaaggcaatgtaatcccaaaagtggggtgtaaagccagaaacccaggagctgcaaagacagctaaaaacatccagccaggggcggcatgactatcagaggaactatacccagaggtccctaagaggatttatccgaagagagagtcagcaatcatgcatctaacagagggtagcagtgcaggttggaactgcaccagtgactcagacttgcccagtcccttacagctcttctctaaaaggccctaagggcagccagtgagtgggagaggaagtcaggtgacaaagagtgtcagtaccatacaccccctggtgcaaggaggctgtcaagcctgaaacaggcccaacctgaggtaagaaattttaaatgattactctgatcaggacttttaaaatcctgaaatgagactgttcttgtgactaaaagacacagcaaagctctgagatctaaccaagacttcttacatggctgaaataaatatattcagtgggaagaggaataaagttgttcccacttgcatcccactgaagctagatggttagaattctgattacagatttattataaatatttaacaaatatataaccatctagtgtttgaatttactgaatatcattgcctttacatcacatacctctgctttcacaattccatgtccaataccctttggaagcagagctaggaagaacaatctaggtagattatactaaagcagttgttaaatatgcttgcatatttttttaaaatcacctaaaatttttctagataacctacacttcaggagtgtatcatcttattgattctgatattgaatttatgatacatatgaaatgcagaataaaattccccagactgagcagagtggtattctcaattaatcatcattctagatgtcatcgttcatcattcattgagaaggaacatttaccttttacccagaatgctctgtctcaggtaagtactgcatcatttagaacacacatttggcattgtcatagcattacaagtgggtcaggcctaaagttaagagcttattgcaactctgcctggcttgatgcccacagtttacaaggaagcatattcaatgccacttaaattgtctgtggttccttctaaattctgaaagaggaagattcctctatgtgacaaacttcaaagctggcagacaaaaacctgtccaggctggacagttaatttcctctcccatgggaaattaacagatctactgcccacctgctaaatgtctgtctgcagagtgatactgaaaacaatttctgacttgtgttaatccacagatattctcagagcttaaagaaggcttcctaacaaatggaaagggggtggcaagggaagccccaggtgcttagtgggttttttgtatcacagttaacagaaatcaatgactactccccccgagagaataaacaacagaggcactaaggaggaacttctactatttgctccttaaaacttgagactctaggaattctgccaagtgacctggaaataagggactgtgaccagaagcctctgaagagagcatcatgcattagcttcttgcagtagaattaaacatactgctaacatccatgcgtgcatattccatctttgacaacttacctatcttctacacaatagaaaaagaaactcttcttttcacatagcctaattcctgacttttcccctacccttgttttaccttttcctttcaccttaatattggctttaaaaatctcattgtaaaacatgatagattctcactgaaaaacatgtatatttcagcttaaagaaataaatatgatataaaactaccccactacctagatataccactatttacattttgatgaatgtcttgccagtcttttcctaggcatatatataacatattgctttcatctttaaaaatcataacttacatactttcataagctggttaaatcccttaggcaattattggtacagagagattgctcactagccagataaacaaatggagaatgataaaagtttacaaacatgaatggaggtgcagacaggggaagatcctttccagacaagatgtatccccatatcagagaatgcccctccgtgcaatttctgtcaaaaggatctaactcattggttccacaaaaagttagtataaatggtaaagttcccatggaatcagaggaaaagtaagtattctgattaaaaagttcatctctgaaagaaaaaaaaaacatgcgactactatgtaattaatgtagatgcaaaggtaattgtagtcagagaggtaaaattccatgtaaagttcataaaatttgcacatgtgcataaaattaaaaataataacaccttccatctaatagagctgatgcactattttcttcattcataatttatccctatgctttattcattcacagctaccacttgtctttgggtaagccaagatctgtacagcttctataccagtgattatgacacaattcctatcatcttgaaatatgcaagccagatgaggaaactcctttagttcagattttcatatatctgtataatggccaaaatataatgaacaattgggaaaatataacattgaaaatctagaaactttatctctatcatacaaaccattcaaatcttatgaaatgtttactgggcacactaagtggttctctttccccaccaccattcaacccactttatgtattaaagacttggcatctatccagtcttctacttcactgaaagtttgccaacattctgggctatttcaacagacacaaggataactggttcaacactcagcctgtcagttccttgacctccctgtctccagtggtcttcatttccactcgatttcagtcaccactctcgcagtcattccttgaaacttggccatcctcctccagaatcagggagttaaaaatcacagttgctggccataaactgcccattttctagattattcagtgtctcctagagtggcttttttttcaaaccatcaggaataccagtccactgactcctccactgttcccaatccataagtcactttatttactttgctccacacaactctatgcactctttgaccctgtcatgctggccttctttgagttcctcaaatgtgccattgaaggagttaaaaatataccattctggcataatgactattgtgaattaaaggtacttgaaaaacagcaggtacaagatcattctggcctcctttctgtttcttaaaagcaggaacactgaaaggtcctctccctataccagaaggaaagcaacattcttatcatcaaggatggaaatttgagccaaagaaaattctgtacagaccttgctaaaatagctcttgtctcttaagcctctccacataatttagttgctttttcacaacttactattctttgtccaattcaatctataactgattcactctaattgtttctctgggtcttcatttcttcatgaggactcccactgctttgtaaaagttgtattaaatcaattcctgtgcttttctcctgttaatctgtcctatgtcaatttaattcttaggcctagccagaaaaaaccctaaaggcgaagagctaaaattcagcctcactcccctacactattgggttgcctttagaacctttgtgcatgctatcctggctgctggaatactaatcgctcctctgtctgatttatgtctgtctattcattctttatatcctaaagcaagtatcttttcttcaaggaagccattcctaatgtgctcagactccctaccattggctcacatacatagcacaaattccacctctatattatacttgacccatttgtgatttctatttagctgaaagattttttttaatgctctgtctctaacaaaataaggcccaagacagcaggatctatgttgattttttttgtttcaccattttataccagctcctaagacagtgtatgatctacagcaaatactcgtaaatatttattaaatgcattcagaataaacaggaagaaggggtatcaacaggaaagtgaaagtaacagaatggagactatatctgatacaacttggcttacttccttcttgaaggaacttgctcgtcttacttccgtcagacatgaggataatctgtcaatcatccagagccttctctaagagtcaagcgatgcaataccatctaaataagaaggcccatgtcagtagtggcccttggataagaactgagtagattctagtaaattcaatgattactggattgacaaaaatgggattatttattaggttatcaatctcatatatgtgatatatatgatatgagctgaatgacaggcaatgaattaaagagataagtcagtcaagtaaaaataatctcatgtatacagaggaaaaaaatggcttttcatggtagcagaatacatataaatctaaaggggatatcatacttgtgttaagtggaaaatatgcataggatagtatctagtagcatcttgataaagcttcagagatcaagcgaaactatgcaataatagctatgtgataaaataaatgtcatgaaaataaagattttttaaagctatctatggtaacatctcaaataactagaatattttataatttgattgttctggtcagctgaaaatcaggctgcctacaagttaaatgaaaaataccctttttgtaagagttgtcattagaaatcctcataagctaggttaactcaagccccgtttttaataagaatagttctatgaagaagctgctattaggagacaggctaagccacacagtagaaagaagctgaacagcagagaaaggtggatctgagagctctttagcaggctctggtgagaccctgggcaatggacctaaccttactgacattagtttcctcagctgtaagacatgaaatcatcgttccctaggatccttgcaagacttcaaagccttttaggcatctattctcttcgtgacatcagtgggctaaactaagaccttttccatttctgtgattttatagttggttctgtgatttttttttttttagtttttaaattttagttgacacatattataataattggggtatcaagtgatatttgatacctgcatacaatgtataatgatcaaattagggtaattagcatatccatcacctcaatcatttgtcatctgtttatgtcgggaacatacaaaatcctctcttgtagctatttgaaaatatataataaattattaactatagttactctaaaccctacagtgttgtagaagactagaacttaaatctaactagctgtggttctgtgattcttaaaggtctaagtgaagcaaagtaaatccagcccacaggcatttccttcacccaattttttgaatatttaagtataaaatacaaagacagaaaactgcagatgtcatgagtatattgcacaatgatctttcataaaatgaacacacatgtgatcagcacacagatcaagaaacagatctgggtgccataaccagcacccagaagcctctcctactccctgcccctacctccacaccagaataaccactattctgatttctaatagcagaaatttagcttgtttttatataatactttatgtaataggaataacacactatgtactgtgccttgtttttattttaaccctggaacacattccactcacctaatgctgctctggggttctagtgcaataacattgttaagagctgcaaaatttaagatggatgaatggaaaggtgaaaaaaaaataaggaaatatgaaaggttgttaatgctaaagagctcattaaactttcaaaggcttgttctaacagatataattaactctgtgaccacaacataaataaacagtgtgcaaagtcaaaagtagcttaggtttactaatacacgtatgtcaaaatttagactcttatcctcttctctactaacacatgcggttgttttttaaatacttgcctctccccagccattttcttttctttcttaattcttccctagatgtccatcatatattccagccacatattctccagtctctgctttttctgtcctgattttaaaaatcaataataacatgtaaaagaaacccacagaaatagtaagtcatatcccttaaccatgggtagagaaaaagcaaatttttaaaaacgctgaattgagttttgacgactctgatttcagaacataaaataattttaagcaaaacttctaaatgtaaactgtgaattaaagaacaaataaagaaatactagccctccattacaataggaaatctaatttggaaatacgcagcatacaacttactttatcagatcaacttcatagtaggtgtcagacttactagttttcttaagacaaagataagcaaatctaaactatttaagaaagaataagaaaaaaggaaaggaagaaaggcctctcacaatgatttatttgaagacagctaaagaaaagttacctaaagtgactgaacctttcttctggggcatgctttgttttaatatgaaaatacaatttccaaattaataaactacagtatatgaaacaagcccattataaagaagtctagtaatttgtggcttgaggatttcccttctactagtcctttttcacattattattatttttttctttttttaaaatcaagacaggatcttgctacattgcccaagccagtcacaaattttttcacattatttaagttcttgtcattgttcagattctatggaagcagatgctgagatggcttatagggcgtaagatatttacatagaagacctgtaagattttatcagatctggaaaggagaaggaagaaagatcaggaagcatgagaaacaaccatgaggcaaatccaatgtctcaaaccagtggagcactctagaacaaacgctgtccatcagagttgtctagtgctggggtcttaacttagtcatcagatgtgaggtgccacaagagggagatgactttgggagggccagctctgtgcagctgaagctgaccctgactgctggaggctctcctgactgccttccttggaggggcatctgaatggcctatctctatgtctgttacagttctttcgtaggacatgagcttaaaaaaaagtttaataggttcaagaagctgagtgggacaaacaaacaaaaagatataaatcagagcaactctagggtaagttcctcttaggaattatctggctatggactgctgctttgatagatgaggacactgaggcacacagaggaggaaatctgcctagtcacatagaacaaacgttctttgtgttatggaaaaacctgtccttggcctgaatgtgggtgactcccattaggatacggagtgatggcaccatcctgtgcaaggactagacacaaatgaaggcattttaatgataggtctgatttatggaacacctttctctggggcagcactgggaacttggctagcatgggctaattaatcttcaccatctccctgtgagaaaggtgggtctcaaagaccattcccctaaattaggagtcagaaagaatgaagtacaaaaggatttctgtaattttcctataatcattcattaaattatgaagtgctggaagacccaggtatttcttagctccctgttgactacatttactgaagcaaatattgtattttactgatagtcatatttaagctatatttctttccctttattcttcatattatgtgcaatacttctgtataaaaagtaaaaaatgagatacactgtgtgatatggtttggctgtgtccccactcaaatctcatcttgaattgtagttcccataattcccacatgtcaggggaaggacctggtgggaggtaactgaatcatgggggtggttacccccatgatgtcatgatagtgagtgagatctcacaagatctgatggttttataaagggcttttccccctttgctcagcacttctctctcctgccgccatgtgaagaaggatgtgtttgcttccccttccaccatgattgtaagtttcctgaggcttccccagcaatgtggaactgtgagtcaattaaacctctttatgaattgcccagtcttgggcagttcttaatagcaccatgaaaatggactaatatactgtatattcttcattttcagtgcaaagatagtgagtgacatggccagtcccaagaaaacattcactaatcccagaaaacttcaagattattttgagtaacaaaatctcacctcaaattttatgctgagttaattccatgctataaaaataagtgatcataactgcaggggcaaagatcatggataaagacacccagacaatccactatttaatcaaactctctactgatatttaaacgacaactgaaatatgaatatcttatttaaatgacttctgttttacatatgccagtaacatattcaattaaaaaaaaaaaacagccttttccagttccattttgtcatttgattagtttgtaattccagtttgctggtttctccagcacaaagtatgtctgtactcaaaactgacattctctaccaaaatatactagaaaaagcatgggatacaggagcagtggacctgagtttaaatcctattctaccccttcctttctggggaaattgctaagcttaattttccatgcatatatgatggaagatgataatgctgtacaggtaactgcaagaattaaatcagattacatatgttaaactttgcatcacagaataggagctaaatgttttagctgttttgatagaagaggaagagcaatcttcagttttaatttattcattttttaaaaaattgccacatataaactgctttaagaggaaagtatatgagaaatttataaaaatgtatttttatatgagaaaaattaatttctcatataaatttataatttcaaattttaatttattaaaaagtcactcagacttttataaattaaattttaaaatgtagctttatttattttttcaaatatcagaatattatcattcaccatttttatgcatttccaaaatttataatgaggactttttcttcttttggatttgaatctctcatttacttcagtaccattcagacttcaacttctgttcaagactgaaaaaaactgtaatgcaattatgagtaggccatttcttccttctttctcctctactccaacttaagtacctagaatcctcacataatctccaatctttctcacatctattttactaaaattatgcaaaaacctataatttgatatttatcttatttaaaattaggaattgtatcatcttagcatttggttcagtaaacacatgaaaagtgttcctttacaatgactattattctaagcaaatgttttaaataaaatattcctcaattgaagtcaaaattagtcatcgaagttttgctggatgaaataaggactaaagtacatggggccctatgactataataaacccatctgcattcactgctttacttagataaataaaagactcatagtttcatcatgttcaatcatctgctagctaccctaaatacatttgagtcacatgatctataatgcagaaaacaaataaaaaggtatttggaaattagtcaatgctcatccaacatctgaaaactgcctttctaaattaaagtgaagagtgaataaaaatctaaggagcaaaatattttaaacacaactaatatgtgttatcttaccctattcatgacatttaattggtgatctcaactccaggtaataggctgtgtgcacttatttttccccacccacctcctatcatacacagacaaaagaaactatctcaagtgggtgtaatggttcagtttcaagcatttcaaaatcctccaccacctgcacaggaaactgtgactgaaaaccagacagggcaccgcagagcagcactgatgatacaggaacatggctgagaggtgaatctggttactagacagttgaatgaaatcagcagaggggagatggtactcccaatgaagagcacatgacacttaagggcaaataaacaccaccatacaatgaaagaagcaccaaaaccggagttacttattaagtgctacggaaacacagatgagagaaaatacaattttacaacaatgcataaaagagttgtgaaggctgatatgggctttgaagaataaataggcgttttctgggtagaaaaagatgaagtaaatttcagataaaaggaatagcatgattaacatcacagagtcagaaaactatctggaaggtttggagaacagcaatagtttgatatacttgtctgtggataacaacctcaaatgtgagcagggaaaaacataaaaagctaacaaattaatcctgtgctaatatgttaagattttctgctgcaggaaatatcggttttgatcagaggcacgaggaaccagattctgtgtgcaacacaatatagtagttaagagtatagattttagagttagactgcctgggttcagactgactttaccacttaggattgtttctgacctagagtgagctttttgacctctctgtacctcagtttcttcttttgtaaaatgaggatgttaacagcacctacctcatggaattgttgagagatttatatataaaaagttagaacagtgcctggcatataggaagcaagacaaaactgctggctatgaatgctgtttttgaaaatcagggttgatgacactgtggagtacacaatggaaccagagaatgaaagtctacaggcagggacttcagttagaaagctaatgaaaattgtatctgtaaaaattaaatgcatctgtgagtacatttctttgtagagataaccacattggatagccatgtatcatataaattaacacgtcatacaaaatatatttacataaaaagtcagacacatgtatgtatgcatgtgtatgtatctccaaatctcttaggcaaactcatatacatgccagaatataagacataaaaacaaatatactccctacagacaaccttgtatgtactgtatgtataattataatttcaaatttagtaagttggaaggtaaatgactgaaaagaatgattgcttttttcttctttgtgtaacagaggacttgctcagaacaagggaagaagatgactatgcagctgctcggtaacagcgtctagtcacactctgagatactgaggtcagcaagaacagaggatgcacactatgtcccatcttgcctttctgcccagaaagtctcagttactggaaaagcttcagaaatatttaccaaaaaatccatttgaaatcctgaaattctacttctcagaaaaacagtattactcttgtctagaaataacattcaggcctcaaagtgctatactgtcattacttctaaaaataaactgagcaaatccaagtcttgaggtcagtttcaaataatgtgctgcagcaatgacacaagcaacagctccactctgtcccactggaggcagtgcattccctgagggcttgagagcacaggcctgctgctcctcatctctccctggaaagagctggcagcagatgaccagacaggcctctaaggcagaaggtactgagcaaagtccttctctctttgttgattctctttagtaaggcacctggagagagtaaaccaatgataggagggagtcgccaatccagcagcctctccagatggcagctcaatttttctcctagcatcctctaaatgattttctaagaccaccatcatgtgtaagaatgcttgataccaccttatatcatttgaacagatacaaatgacttacatttcagacttcttttttttttttttttttagacaaggtcttactctgtcacccaggctggagtggagtggcgcgatctctgctcactgcagcctctgcctcccagggctcaagcaatcctcccacctcagcctcccaagtagctggaactataggcgtgcgccacaacacttggtaattttcatattttttggtagagatggggtttcaccatgttgcccaggatggtcttgaactcctggcttcaagtgatcctcccaactcagcctcccaaagtgttgggattacaggcatgagccactgcacctggccacatttcagactttaaataggaaacacatgagcccgtgaaaggtaataaattaggtgtataaattatgaaaaattagagaaaaacaaaattaggtaatattacaagaagtgacaagtagagacattttaattttatgtcaatgtaattaattgatgctataatataaccaatgctatttttgagagatagggctgataatattgtggagtatggaaccagagaatgaaagtctacaagcaagggccaggcacggtggctcatgcctgtaatcctggcactttgggaggctgaggtaggtggatcacttgaggtcaggagttcaagaccagcttgaccaacatggtgaaacccccgtctctactaaaaatacaaaattatctggatgtggtggcgcatgcctgtaatcccagctactcgggaggctgaggcatgaaaattgcttgaacctgggaggcggagattgcagtgagccgtgatcatgccttgcactccagcctgggcaacagaaagagattctgtctcaaaaaaaaaaaaaagtgataaactaaataaacgaataatgaataaatgccaagtcactaaaatgtacttgattctaagcaagatatctgctattaaaacttaatttttatcttgaaagaaatgggaagaaattatcaaaatattttcagataataaactccaaataactgatatttatctacatagaaagttgtcctttactatctttgtagtagtgtcttctactatggttgtagtagtgtcagtgcctgtactttttctcaattctctgtaaaaatacctaaatattgtttacatatctgaaaaggtacagggacatacctatattcccaagttttcccttacaaaagtaattaactttttatttctctgctttgctagcaacaaaactctcaaaatcttaagtaaggtacccttctaattgccataataattcaaacatttctttaggacctctaattgtaagagatgatttttattacacctttgatgcattaatttttaaatttaagaaggaagcacacagcttacttttggaataaatttcctcctggagtaatcaagaattttggaaattaattctgtaaaaattgtgagccacaacccaagcatctggagtcctacaatgctctcaatatatttttaacatgatcattgagaaaaaagccatcagcccttatttctcaacgagagccattctcatccatagtgattagtgtgagattttacgccaagctttcatgagttttaagacaaacttattaagcacctttcttatttacaatacaggtatgtgtatacacacacacacacacacacacacacacatacacttcaagttgctcaattttaaaataaagatatcttttaaaaataatataggtagaagggaccaaaaaatgtagctccaaaatgtaaaactccagattcatggatataagtttcccaggaaggaaaaaaaatcaactatgtatataataaaatgtttgcaaaattcacctggtaaccagccatgagcacatgcattctcttctttgaactgatatggtcgtgacctttctaatctgagtatggaaaattattaaccttcttctcccttccccatttgaaaaaaataatttcaacagtcctcatgttagatttccattcaggtgttactgaaatgtaggaaaaacacatattggagtatgtggtaacctttttatatgttcccaagtaaaacccatagcaatacaatattcacacaaaatgggtgatgggatgttttttaacttactaaccatcaattgatcttacatgtcattttctgtggcttgtggtcacaaaccctcttcttaagggcaagcgaggtcatcaatcaaatccaattcagatggcttaaccaactagcatgcaaacactgacaacctaaatatctgttaggccttttattaggtgcactagtgactgacatggaccaatggacactgccctccaactcgaaatcaacaagtcagacaaagggtagtaatatagtttgctacaagaaaagagcaagtttgtcttgtgactaaacaaggaaactttcggtctctaagggtttttatctggcacatccttcatatgaaataacaaactcaagaattccttggacacccaaccaccagttgaaaatggggagcttctgactgttcttgccagtaacataaaagcagccaaatacaaatggactgtttttattctcctttgtctttaagatgaaatattaaatcatcaggcaccctacctgtttcctacatcccttcttggttcaatcatcacagagaatcttgtgcaaacattataattttaagatacttctctgttacaaaatgatacatgaattataactaataaagcagtacacagaataatacttatatttgcaaaatgaaatacacacacggagagaaataaaacattcactaggtagatcaggctcagcaaaataaaagcatttaattctcttgattactaaataatgactgattttccatggttcctaaatctgaaaaggccttccagaaaattctgccctccaatgtaatctatcaaaactatatctgttgcaaaacagtacaaaattcttgccatccaaaagcagcatgaagcaaactaatggatctctccttaagattatgtatctgccaaacgtgtgtccctcacaaggaggtctgtgtgttcccagaatttcatctggtactaacctcattcaaaaggtcttagaagctttagtgggagggaaggtgcattcacctttctaactatgcccaatctttaaatatgtgaaaataaaatagcttttcatcatttttcagttaaatgacatgctctctgttatatgtacttgacattaaaaatggcatagtaaccttcatctatttacaaaattattaccttcatacacgtttctaaaatttgtgtctctagcctgcactctgttctgatttctaaacacttccagctgccagaggtccatctccagatggctgtcctatgaggcacctcagaaggaccctccacagaacagaactcatcctcttctagttcctattgccccaactgatttcctcacctttaactccttggtttccttcatccctgcattcagtcacagaattgccaacttccggaccctatatatctctgaagtccatcacatctttgctttccagtttccactaaacgaggccacctcattattgcttcttgtctgaaaagctaagagagatttttaactgttttcagtctgtctcaaaatcaatcctataccccaaaatgaccattgaagaaaaaagagcaaaaacagattaatatacaaagaagatgcaaaaaaaaaaaaaaaaaaaaaaaggaaagagcacactaaaaaaaaaaatgatggccgggtgcagtggctcatgcctgtaaccccagcactttgggaggccaaggcgggcagatcacgaggtcaagagatcgagaccatcctggccaacatggtgaaaccccatctctactaaaaaaatacaaaaaactagccgggcatggtggcaggcacctgtagtcccagctacttgggaggctgaggcaggggaattgcttgaacccaggaggcggaggctgcagtgagctgagattgtgccactgcactccagcctggcaacagagcgagactccatctcaaaaaaaaatggttaaaaggataaattagaacaaaaaagaagattattttccaattaatttcctactcttgtcaatctctcagaaagctgacttcctccagcatgaacaaagctgtttgatgctgagaacaagagaactctccagttacatttgttcctgcaaatctccactccagaatctgtttcatgcagaacccaacctaagattcaaggtctgtaagttcctattaaactagctactccctgtctctccaaccttattttattctactttcccttttgttcatgatactccagatacattagtgccctttctttgcctccatcctgtccttcttattctttcagaaagtttgcacttccttttttctctggcttaaatattctccccttgctttttccacgggtagcttgctcaaatgttaccaattcatcttcccttactgttctttctcaagcagccccactatcattttattgattggaatcacatcacttttgttatttccttcatagcacttactacaatctgaaattatcacattttatcacaagtttgacaacttgtataaaagaaatctgttctcatgccctaccagttttccattcccactagaacactaacttcttgaaggcagggaacacgttgtcttgtttaccactgtttcttcaaagtctagaaaagtgccaaacacataatgaacactcaataaatattttttgaacatataaccaagctactatgaaagaattaacattaagtttgaataccaccaataccatggtgggcgaataggtgacataagagaacctccatgaaaaatgacaaaatgaagccagatcaggcaggataaaaggaacaaaaagtagctcaaacaaagaaaagaacaaaacttagcaaacctcaaaatttgatgaccaaggaaaacaaaagaaaattcttgaacaatttaacatgatttataattcacctccaatgcaaccctacctccattcctgaattcatactactgaagatgttggtaaaattgtgatgggagaacacaaggtcacaggtccataacttctactactcggaccaataatacatctcatctgaattcctatattagccaagaaaaaaaatctatggaaggaggtcccaggatgtttaaggaggtaatttaaattaaaaaaaatgagctcccagttgtgggcacaaaggtccccctgagcagatgtgttcctacactgatctttagtcttatgcctccaaacaagtatcatcttggataaactgaggcaacagtatttaattatacattttattattattaagagccaaagttgtattttcaaaatatctactaaatgatgtctatattattgcacatttcccaacttccttatctttttgccacgtatgatgattagacttctctcccatttaaaaatatctcatgctttcttactaatgttgaacaatttccagatcagtcctgggcaagttttaatttgaattaatgtattcacatattcattgatttcattatgcactgtgcaatttgagagatttataagctactgtgagactaaaattcaaaaatggctgttctgtatttattagtttccacatagtttggggccagttgtcttctctttctgaacacttctcttgataacagtaacagatcacacaggaaatatgagagattgtttatgaatgccctgagacccaaaatgcttagacataaactaagattaatttattgcactaaagaagtaattacaagcagagtaattaagattcacaattgtcttgggatttacaacacagaatattccttaatagaacactctggatctataacaaccagaatccatgacagcaattcaccaccatcactgtcacaaaaaagatactaaagggtagaacaccctccattaatattaaaaagacatacgtcacccattacaacactttggctgaaaatctacaagactgaaaactctacctagtttgcatggagtgttagatttagttaccatacttgctctaccaatagttcagaacatgaaggtatatactttagattacagctatctgtgcctcctgaattggacaactagctggaaagaagtgcacatgctaatggaaggaataaaggtaatgctatctggctgagtagattttcctgagctacaatcattctactgatatatctaaatctaaaaggagcaaatgggtcaggggcacagtggctcacacctgtaatcccagcactttgggaggccaaggtgggcggatcacttgaggtcaggggttcgagaccagcctggccaacatggtaaaacaccgtctctatgaaaagtacaaaaattagccagacattgtgtcgaatgcctgtaatctcagctactcgggaggctgaggcaaaaaaatcacttgaacctgggaggcagaagttgcagtgagctgagatcacaccactgcactgcaccctgggcgacagagagactccatctcaaaaaataaaaataaaaataaaaataaaatgagtaaatgtttctgaatggttgaggaaatcccaccaaatacatttgccacactatttaaatgggtggtgagggaaactggccaaattatgcaatgaatcttctgtgaagtgtggccaatgaatataattctgtgttgtgctttaatgaaattttcttcctattcctgagaaaaggacaaagaaaaatagcaatacatgagaagaagaaagtcaaccatgaaacagttacgagcaagaattaaaatgctgctgaggaaaccactgaataatttaagagttcttgctaagtgcctcaatcttcaacctcttgttctctaagagaagattatctctagcactcaaggttctttcataaattccaggtgccttgtgtctgcagaagagttctcaactgaccatatttcttccattcccaaatcaaaacaccaattcatccctacctaaggagaatgcaaacagttatcctcagacctcctgataaaatatatttaaaataagtaacatcaatttgatatcgttcactacattaaaatatggccataattttctaagtttgtgaaaattttgagtaatattaaattgtgattatttacatttacatggtactactgtaattcctgttgccctaaatattcatacaaaacatacatgcacaaaatatttgggaatagggaatatatctatacatatattcatacatacatattcatatattcatacatacatatattcatgcatacatattcatatatcatacatacatatattcacactattcatatagtcatacatacatatattcacacatattcatatattcatacatacatatagtcacacattcatatattcattcatacatattcatatatacatacatatattcatacatacatactcatacatacatacatatattcatacatattcatatatacatacatatattcatacatacatattcatatatacatacatacatattcagtgtatatatctgtgtgtgtgtgtatctatctacctatctatctatcttgatatattccctggatacaagtatatacattttacattattcttagaactattatcttcatagactatcacttaaaacaaatcttttcaagttctattaatataatttgcagaactgcttataatggttttcataaagacacagagttcatgaaagttcttacttttacttccgtattcaggcaaaaacccacaggaagtcattatgttccctctgacctacaggagatgtaaaaaataaataaaacaagtctacagcaggtactagaaactggtactaagccaacctttctgagggatactgtccatagaatggaaggcaagaagtattctgagtaaggggtcataagaaagccagtcctaaaataatctcctcaagcagcagtcctggcctgtgtggtttcattacgttgtcagaaccaacatttgtacagtttatgagccccaaagctcccataaaaaattcctaggagaccagcctggaagtcaagaaagccaaagagggccttagctagttctgctaaattccaaaatgctaacagattttttttttagactttattagtgtaaagcatttaaaatattgcgttttattggtagcttcagttaagaccttgctaaagattagctactcacttgccaagacccaaatactcctcaaactctgatcctcacagagaaaaaggaaacatcaagtaaaggcagcaagtgtcagaggagaaagaactaatgccctgtttcccttctctttgtgtctaattgtttctcatattccctgcattccacctgggatggaaatgtttgttttttgaaaggttagtagggatttattggaaattttcgctcaggacctaataacttaaaagatctgctgtgaaatctgaggacagatatggctatcaccaaacacaagtataaaaataaaacaatattttactatcaataaaaatgctttcatttgtctagattaaaattgtttggagattactgaaaggtaatttttttttacttttttacactatctaaataatattttctaattttcatgtctatcaaaatgaacccaaataggaagacatatctgccacaaaccattctataagcattccaaagctaaataaaaatgaattttaatatatctactcacttattcatgctagagtagcattaccaagcaaaaaccaaaacactcctcctctatatacaatcttctcatgtttgttagtcttaaaaacctcacatgaaaattaaagacgcattcattatccatatcagctaaccagtttatctaggggtaggcggattaatacaggggtgtaagaaacagccaatttgctcagagaatggaaataccatatgatatcatctgacctcaaactttaggagtttccctgacccccagattaatggagcatcaagatacattaaagacttcaggaaaaggaagatctagtttcttagccactgatgatttattaatgaagcattaacacaaactcattaatgctttcagctcttgcaatgaagctgccctttattaagtgcctccaatgtgtttatgttttgagaagttaataattaagaaaaaaggcatcgtgcacatcactaaaaaatgctttatctatgtctcataaaatagctatctctatgaatgaaaaagccaagaatggagtttataagaggctcttatttggggaatgtgggtcacatgttcactaactttagtgagaagtgggaggcaggtttgactggaacattgcccaagattatcaccaaaacctgtggggtattggacagataggaggggcagatcccctttgctgtgcactctatcttactctgtgcttcatcccatccatatatgataaaaaagaaagtaatttataagaacattgtcaaaaatgtcaaaagatcagttttaataagcttttccttataagccacaccatacaacccaaggcacaattcagtgctatcatacattgtgctctaattggtttactacgtgagaccaggctttctactaattagcaaattttttgaggccagaaacttttagtaatatttctcttatttcattctcagtacaggtacacagtgttctttaagtgtttatagattgattcatgaattattagcatatggttgatggaaaaataaatactgctaataaaaggaacatgaaaataagtttcgcactttctatttagaacatgatttgatcacaacctaatagtcaccaagaagatgctgtcacctcactacaataagcacttactctgattacatcacgaagtgagaaaagaaaagtacaatgttcctccacatctcccaagctggatgataactgtcaatactaacttctgccttggaatttgtgggatgggaagataggtaagaagagtaagtaaaataaagaaaaataaactaaggggggaaaaggaatgacagaagaaattttgaaataatttcctattcagtctcagtgattcaaatactgtatattgacaagcctgaatttttatctccaaatttgacctctctactcctcccctgaattctggaccatatccaagggtcaactctctatctccatttgaatgtctaaaaggcatatcaaatttaacatgaccaaacttagctcttgttccttcccaccaaacctattgttcctgcagttttccccatctcagtaaatgacaattccagcctgctaaattgctcaggccataaaccttatctttgaggcaattcattccctcacaccccattttcaatttgtcagcagctcctatggggtctgctttcaaaatataaccagaatacaactacttctcaccacctcccctacaaccacctgggtccaagccagcactgtcttacctggatcacttcaatagcctcctaatttatctcccttcctttcttgcagtttactttcaaccaaatttcaaccaagtaaccagattgaccccattgcctcctaagacagataacattatccctgcacacaaaaccttccaaatggtccccatcgctcacagtgtaaatgatacagctcttgctatgatctgcaatgctatgtatgagctgtgcccctgccccttaccttatcttctattactctcctctgactcactgctccaaacacactggtctccttgcttctctttgagcatattacgtatgctactaactcaggacctttgcacctcctgacaactcttaggaagctcttgccacagatatccacatggctattcctttacctcattcaaaacttgtctcaaatgcaccatactaagggaggtctttgctaagccatcatatttaaaattgcaacgcacaccacttgacagacagacacacagacacacagacacacacacacacacacacacacacacacacacacatacacatatactccttagcccccttcccttgcatcattcttctccacagccctattaccatctcacatacttctagtttacttaggactgaaatgtaagctccatggaggtaggcattttcttctgttttgatccctggtatatcaccaggacctagaatggtgtctaacacatataacaatcaataattattttttattaagttggtggatccattaagaagcaagagagatgaattaaagtctctacataaaaaatcacccaaaatcaatcttcagtcatctccctggtcttctcaagggttgttattacccaccttctaatatctattgataatagctattaggtaagtgtatttgtaggggccaggagcagcccttgccttctcatcttcatcacggatgagataaaatatacacagaagccgcacagtaataatggctaacatttgaatgcttacaatatgccaggtactgttctaagcactttaatagattactcaatcctcacataattccaaaaggcaggcttctctttcattctttcccagaggagggaactgaactgtagaaattttaagaaaccttcacaaagctaggaagtagaagagtcagaattctaactcaggtcatctctccagaggtcatgttcatatcccctgcatctaatggaaagatggtcccattaggagtacagagaaggtaatgcatatgaacgttttgaggtagtatgaaaagcagcataataagaactaacacttggatatacaaagaagcacaatgtccctcaatgtccaaggagtcttgatttggtacaggaaacagtagagacctgttgcatctgagccaggaggtcagtcgtactggaagagggtctcactataggcacactaactctggtctcaaggttttgaagaaagaagggaaggcaaaatctacatatggaaacatgtatatgcaagagcatggagacaaaaaagaatgtgtttattcactcattcattcactagccattctaagcctcccatgctataggcaccagaggcactaagaaccaacagataatccctgtgcttaaggacatagatagttacagaagaatgatcaagaaaccagcctaaatagatgcagtttgttggaaaagtggaggaagagcttaacagacaaaaagggaagagattatggagattttcaagagccaggagtttgaatttgaatgtaaaaatatattaattataactttctgaggtacacaataaatatttgttgaataaaggaaatgctattctaaaatactttcaaacgcctggcctactatatattttcttctttctgtacttggataactattgcaacagaggaaatcatttgctgacatctctcaacccaccaataatcttggaaaatatgagaaggagtctttcttactatactaagccagttcttatgagaaatgactcatataatacctgttttaagatacctaaaaaaaattccaaagcatagatgatttttttcctctgaaaatgactccctcaaatagagtccttggaattaatgaaatagcccattttctccttgaattaaactccgaagaacaaatgcagaagtcatggtgtttaaaagaacccaccttcttcctttctgctcacaaaactagcgagtcacaatgtttactcttctggatcacacaggagaaatcatttataaatggcagtacagatgttcctcaacttattatagagttacatcccaataaacccatcagaagttaaaaatattgctaagtcgagaatgcatttaatacatctaacttaactgaacatcacagcttaacctagcctaccttaaaacatgctcagaacactttcattagcctacatcatctagcacgaagcctattttataataaagtactgaatatctcatgtaatttattgaatactacactaaaaatgaaaaataaaatggttgtatggttaatcaaattacagtttctattcaatgtgtatcacttttgcaccataataaagctgaaaaatcattaagtcaaaccatcatggataccatctatattccatatcaatgctcttatttgactcttttctcatacattgacttggacatgtaaccaaagatctctctgtgcctcaaattcatcatccgtaaaatggggatctcaatagatgtaccttgtacagtttctgtgataatttaatgaggaaaagcacatgccatatgtatacagcagtgtctggtccattgtaagaactcaataaaatgttagctatcctcattattattatcttacacacttttattttctagtagtttgtattttaatttaaaatattttacaaatatatttactgctaaaacaactcaaacagtagagaaaagaaaaagtaaccaagaaaatcccttcttctccacccctggctcctttaatcccattctccaaaggtgttaccatctgtctttccaaacatattttgtgataggtatatgacatgttggatgaaagaagctaattgcagaacagtttacagagtgtgatccaatttacataaattaaaaaatgggtatatagctatatcacctgtcataaaacatgtctgaaaagacatgcagatagcaatttcactttggagagtgaaattaaggacgccaggggtggagaagaggggaatttcatgttcactttttctacatttttgggattatgtccggataataaattctagaagtatgccttctggagcaatggttatatctatatttccattggatagatattgccaaattgcctagaagaaatgatgtttctcagtggtattccatcaactgagaacacatataatgtgatccctgggcttatctactggcaaaggcagctaaaagggattgactgaggagccaacctgaacagagtacagaagaggtttgctggaaaatatctggggatggtatatctctcataggccatggaattaaagtaaaaaccatatgaaaaatggctactttggttttgtttatctgatagttttttcttttgtttaatatctatgataccacccacatacctgaactaccaaggctttacctttccagacaatgtattctcagaaaaaagtgacatatttaagtgctattgattcctttaacattatgttgtggatactgaagcatataatctaaggtttactaagaggtcggctctcacagaacatcaactagaagctctagaagacagaggacactaccacgtttctactctcttccactctgccccactttccagtcaccctctatgcctaatcagtgatttacataatctataaacattttctgcccatcatcaagaaaaataatcagatcagatttatggggaataaaaaacagccccacatcaaaataacaaaacaaaacacattgtgggaactccaatatagtatatacatagtacatacattttgaatgttgagattaaattgttctaatgcaaactgaaataaactcaatcctatgtatctgcattcattatgatataaacatgtcttaacttgtattttgataaaccaaggcactaacttttaaaaataaatttatgagcaaaagacagtcattcttttagaaaactactaggtactttgataatacaaatgttccttaggaattatgagtcatgttaagaagatagttctactacttgtttatttcatttcaaatgactatgtacttaagcatcctacattcctgcttgtctataatatctccatctggtactttttgaatatcaaattttactaaattgtttctgtggaaacgcaagtatgtaatatccaacgggcaactaaattgaatttatttcagagttactgattaaagccagtcaagattgaggcaacttttcaaaaaggaaccaaagaaaacctgctaactttaaagaggcaaccatttccctgcccccaagaagggttatgggttatttttaataagctcataattgtatattgtccatctttacttttgtcaataaaatttaagtaaagtatattctaccaattcataataaagaccaaggagggataaattctttcgggttgagaaaaatcaccatatactgacaaaatatttatttcttgttcagttctcaaggcagtaacagtggtaagaaagtaggctatttcaactcctgctggctctgtgggcatgattctaaaaggtagtcttgtgccacacttcccaaccttgttaacaaagggccctcctccttagctttaaatagcactatcaaataaccaactccttcaaattgagaaaaaacaacaaaaataaaaaaacactttcctcaaaaccagagtagtgtaagactgtgaaacaaacaaacacaggaggtcccaggtaaactgcttcagctacctctctagggtgaccacacagttcactttccctcctgacgctggctgtgggcaactctgttttctctgcagaaaaggaaaagaaagcaatcatagctaactggcaagaataggctcagctgtgtctgctggtatttggaaaactggagtgggcaaaatgccaggccaccctttagatgagcctaggacacccttgaagggtatccttcctaccctcttcaggaatagactaagggaaaggaacctgatccatccttcaggaaatatccatcacagtccatcatcagagtaatttcaagttctcaaatttcaactaataaggttttagttaaacaacgtattcaactatcacttactgatgatgcatgaaatcaggcactgataaaaaaaaattagcagacaaatggatatatttttctttaacagtttctgttccctataatcccatttgtctttactagattaattcttctaaagcactgttttcttcatgtcacatccctgctccaaaagctttctgctgtccccaggataaagccttttgggcaatcttatagcttatcatttcaaacgtagacactgtgggctattcaggtcattaatctcattcacctccaaaagaattttttattttttccctctgtctctttgtttacttaactctcaacaattggaatgctattcatctttttgcccattgaaggttggattctcccagtaacagcagactctgagatggggtgtggtatgcaaaatgttgattagagaattcccttgggatcagaacctcagtaaagaagcaaaagggtgcagaattgaacagggagagaagctaggccaaagcactggtccaaggaaaattggccaacaccttaaggagctctggagctaaaatacagaatcccaaagttgtctcaggttagctaaaatgatgggaccttcatacctcccctgccattcgtcactgaatatgggccaccctgggaaagttatgaccttggacaaggggcctctttacaaagcagctgagaccgtacgtaggttttatgttgttgttgttgttttgtttttttttgaaacaggatctcactctgttgtccaggatggagttcagtggcctgatatggctcactgtagccttgtcctccctaggctcaggtgatccttttacctcagcctctagagtagctgggaccacaggcatgcgccatgatgcccagcaaatttttgtagagatggggtttcaccatgttgcccaggctagactggaactcctgggttcatgtgatctgccttcctcggtctcccaaagtggtgacactatagatgtgagccaccatgcctagctcaattagtagttctttgaagggggatctggggagtgcatcactattttatcactcttttctgctcaaattgttccatccttcaagatcccctctagtgtacttctatatcatacaatgcctgaatacattcataatactgtcacttaataaaatttcacttccattatgtaacattactaagaggttactttcactagagtgtaagatgctagaggctaaggtccatgagttctaccctcataacttctttagaacaagggtaagcaaacttttttatattaaggaccagacagcaaatattctaggcttcgcatgtcacatacggtctctggtgcacatgcattttttatttacaatcctttaaaaatgtaaaagtcattcttagcttactggccatataaaaacaagacagatatggccaaagggaccatcatttgccaacttttgcttaagaatagcactattgaatggaaatttaatgcaagccacaaatgcaaaccacatatataactttaaatcatctggtagccacatttcaaaaagcaaaaaaatatataattttaatggtatattgtatttaataaaaaatattcttatttcaacacggaattaatatgaaaatattggttgggcacagtggctcacatctgtaatcccagcactttggaaggctgaggcaggtggattacttgagatcaggagttcaagatcagcttggccaacatggcgaaatctcatctctactaaacatacaaaattagctaggcatggtggtatgcacctgtaatcccagctactcaggaagctgagtcatgagaacccaggaggcagaggctacagtgagctgtgattgtgcaactgaataccatcctgggtgacagaacgagactcttatcttaaaatatatatatatacataagtgattttacattcaaaatcttggaaatctagtgtgtatttcatatttacatcaaatcttaattcagactagacacatttcattttaagtgctcactagctacatacagccagtagctgctatactggacggcacagctaaagaaaataggggagcatgttttgataaatgtgaatttgttcatttaaacagtactcactgagttctagctgttgagaatacagattgatttgtgctaaatatgagaatacagatttaataggattgaattttcaccctcaagtagtcgagggttcagtgagtgatacagatagatgatataataacaatgtggtatattagtggtgtagagaaaatgctacagtaaaattttaaaaataggttaggtctgttttgtgttttttgtggcttttgtcttaagacagggtcttgctctgatgtccaggctggatggagtacagtggtacaatcacaattcactgaagctttgactggcccaaactcaaacaatttttccacctcagcctcccgagtagatgggatcacacgcgtgagccactatgcccaactgacttttttatttgtagagatgcggtattgctatgttgcccaggctggtcttgaactcctgggctcaagcaatcctccagccttggcctcccaaagtctgacgtgagccaccacgcctggccagggattaggttttaactggtcaccaaacctataagaacttcttcaatgcactgttgattctttaaaatcaaaattttttaagttaaaatgtttggacttttaaagatgtatttctttttacaaataccctctgaatgaaggaaataaatttgggatgcaacaggaataacactacaactggataagaagtgcacaatctttcatgatgaatggatgatctattttatagaaagcacaaaatggagggtgtattttctcaaagtatattttgaatttctgccatggttgcagctttctatttcttatgacctttttttttttttttttttaagaaccaggtacttcatgtggcaaaatgatggcttcttaaatctcaaatacctgaaaacctttttgcttgtttttgtacaatcacattttgtgattcatcagaaaacataattgatataaagtagccttagaagcacagtattattcttaaaaagaatcacagggccttctttcccatagtgtttatctggaagtcagaggaataccaagtgaaatttaagtattttctataaatatataagattatcatttctatcagttcccctctcaataatctaacaagcttctcagattttatgtccttaacaattctagaatgaaaataagataatctgcaattttttttccttgtgcctactgaaatgtcattattataagctatttgattgtactgggatattctggcatattttactaaaaaaattgactttattgttttatataagaacaagagaaaattaattttcctcactagcaatttaagttttattatcccaaattcattttatttaaagcaagtccataatcacattttattcttactagaaacacgtatattgtaatgtataccaacagagaataaatgcacatttaaatcccattagtactgtggaacatcatcctaatttacttgacattttctgaggagaaaggttactatttgagaaggaagtgagaagggagagagtgattgcattcactcttgaaaacagtcatagaacctacagatcctcaggaaaattcaaattctcatacacactataaagcccaccgtgaatccacaaaagtttatttactctaggttaagaaccttttcactaaaaactagatcaaatttatcagtgaaaaataaagcactgaaattaaatgaccaagaaggtattattaacgaggcttttacagttctggaagttatactacacaagaacaagctgcctgaataaagtaagaattgtcaaaagttagaaccagggttaaacaaactatggcaggttaaaaaaaaaaaatgaagagcagatttctttggcgctcagttgctgttaccaagttatatttaatcagatatcagggtggtttccagaaatacctcttcctccttaaaaagtggtagattccggccaggcacggtggctcacgcctgtaatcccagcactttgggaggccaggatcgagaccatcctggctaacatggtgaaaccctatctctactacaaatacaaaaaaaaaaaaaaaattagccgggcgtggaggcaggcgcctgtagtcctagctactctggaggctgaggcaggagaatgtagtgaacccaggaggcggagcttgcggtgagctgagatcaccccactgcacttcagcctgggggacaaagtgagactccatctcaaaaaaaaaaaaaaaaagaaaagtggtaaatggagcctagcactccctacttcaaaagcttgtttagatgcctcaggttctctgatttctgcattcagcagctatatactccacactacaactacctacacacaaggaaccacccaaaggcctttgcatttgcttttaaaaggtagccagtatctggccttcaagaaggagacaatgtaagctagctggtcttgaaaagtttttagttctgaactaagcgctaggtatatgagaacattctgtactatcttttcagctttctcataaatgtacaattgttacaaaataaaaagttttaacaaatgtgctcttctaagagactattcaaaggtagcttttgctttctccatagatctccttagactggagactgtattttcttaaaaattgatagtgaatgaaatttaatgggaagaaatatatttctcttgctaataagcctcctcaacattttaaaaggacgtaatgtatgcatcaagaatgcaaagaagaaaaccattctatcagtctcagtgaagccttctcaaagcaaggaaccctggcatagttgtggggaagagctccaaaaacctgtaacaccatataactttctgcatgtggtgggggcaggagacagagacacgggcggtgtgtctcatgttaagatcaaggctaaagagagaaaattgctcctcatgagtaaaggagatgctaattggctggtaaagtagttaagaaattttgaagtgcttttccaatagctgcactgagccacagattcttttctatacaaaatggctaattgtaggacttatggagaaaagctaacatctatcaaggactgaactagtattattaaaccagtgatgaacatcctctcaagtactgtacagcacttactgaatgaacatgaacttttaattaaactaaaaaagcatgtgtgaaaaactcaaattataaatctataaatgtgtaacactgtaagagacaaaatgaaaatggtaggtgcactaacagaaactattctgttgaagtcatgtgaaaataggacattccctaaataaaaatgataatttgaccccttgtctataactaaaaagttaaattactgacataacgtggagtaacaaaatgagaaaagttaaaactgaaaggggtactatgctagtaactcctaagaaacaatgagattttataaactatataggctctgaagtgaaaaggaaatgtggctcactattttaacaaaatatgtacattttagagtgagttttaaaggatggtatggctacaactttgcctactatttagtgctatttaacatttccttagtaaaataagtaatgtaataaatggcaagcttattaaattcccatcagcaaataaaatagatacaaagaaataactttggtggattagaagtgcttttaaaatggggttagtatattagaaaactctacgtaattaatgaaatgattcagacagttgcattatcaaccattcaggcataagttatttcccagtgtaaagaaagaaagcatttttaacaacacaatcactttgaatacattaaaatcttttaaaaagttttttttttcacatcaaaatatccttcatacttatgcaagtctttcctgtcattttgcaaaataatatgttctggaatataagacacagcatacaaggtaaaggctggccacgtgcgagaattgaaatgtagcagaaaaaacacaccttgtaccatagcagacctacaagtgaaatatgatagcgagccaccattctcgttgtgttttaagcaagcacattactggggttcataaatagaaaattagtttagaaactctgaggtaagtttcttattttactcatcactgcttgactcatgctggctatccatgcccagttatgatctccacatctgaaagggaatgcagagaaataaaaaggaaggaagcccacacagatgatgaaagggttggaaaaagaagaaagatcaaaaggatacaaggagtcaggctgtgaagaaaaacctgagggaatgctttataatgttctagaaatatatgggttattatattgggaatggtaaccagctgttctccatctctatttaggacaaaccagaagaaaatggcttaaatcaaggcaatgacatatttgggttactaaggaaaattgtggaatcttttctagaattatttaaactagacagatatttaatgtacctaggctggctcaagtacaggagtgagaactataatctgatttacaagatcctttttaactccaatttctgcatatactttatcaagacaaatatactaaaatgcataaaggaactattaaatattattgaacacagtcaattactccaaatgatagggggcaatagaacgaaaattgctgtaaatcaaaccataatgtgaggcaataggtaagatttttaacctcagaatgcttcagctctctagtggcattgtctgtagaaggagactgtaacagtatctacctgtctaagtgctgtgataataaaaatgagataatctgcataaagcatctgataccaattctctggaatattagaggctcagttgttagttcccttccattctctggtgaatacaatacataagattttgaattttccaaaaggaatgaagatacaacaccatgaaacttccctgaatttttgctcatattattcacacaactgaaaagtgggaaagtataagtataccaaccataaaaaaaaagtcccttctccagtctgtaatttcctatcccattctctcccccttccctggtgttcacaggtctgagcttttttttgaatagcaccatatttctatattataggcaaattgtggtcatccaaaagggtcccacatttgtgttactagtcatcatggctcactttttaagtggttcatgacaaagtcaatgccagtataatcagaaggcttctaaggtgtttagtattcatcaaacaaaatgtggttacaaattccttcagaagcaaacaattctataaacaattctcaagaactgggctgcatggctggagagtctccaactgacaataaaatgaacgaggaactggtgatgtttgccagagttcatgtcctttagccacctgttgcctggtaactaactgggctcacctcttcattcagaccacttctcagatgctacagtaaaattattctcacatgcaaatcacctagtaattttcacatcaagagtgggagaaagtttttttttcctcagctgtaggaataatcttttttaaaaagctaaatattcctgacagtctacactctactcataaatgtgctatcaaactgaacacgttttcttcccttcaaaataaaaggttttgttgttgttgttctttttgttgttttttgagacagtcttgctctgtgccccaagctggagtgcagtggcgtaatctcggctcactgcaacctccgcctcccgggttcaagcaattctcccacctcagcctcctaagtagctgagactacaggcatgcaccatgtctggctagtttttgtatttttagtagagataaagtttcaccatgttggccaggctggtcttgaactcctggcctcaagtgatctacccaccttggcctcccaaagtgctgggattacaggtgtgaaccaccgcgcctggcccaaaacagaagtttgtttgtttgtttttttaatggaactaaactatgtgaaattttaaggacagaaaaatattgatacagtaagctgatttggctataaagacagaaaatcctttttccatttagtttttaagaataaatcactccatcatctgtgaaataaattacattctctcaaaatcatctcttgagtatccacattataatctagcttttcctgcagagaaattttacttgtaatccaaaataaatgtttttctcaattccagataaattaagattatcattttttatgacttaagaatattatctgttttaacttaaatatattaatattcactgaattatatcaggaccagaaatgaaaaaaaaagtgtttaaaatacttgtcccacatcttgcaattcaattacaacacaagacaaacagaaaaaattagtagaaaagggaagattgtttttaacatatgggtatacgtacttagaaggtgaaaggtacagggtggaatgatttaaatattttgggggctgattggctgaatgtaagcaggctgtactagagaatcactatcttacaatcttccaaattcctatgtccctggttccaaagagtcagaaatgccaaatgccataaggtaactatatgaataaacaatattccaatctgctctgctttcaaggaggctttcatatgtggagtagagtgaaaagctaaaagccgtgaacgatatatatatatatatatatatatatatatatatatgagagacttcacactgaatattaatgccccagaaaataaacaggagttaactaggtagaactcccttttatgagcaaaagcagctccaggttttagaatggcatttatttttaatttaatgccaggcacgggggtggtgggactggcaaacctgcacttttatctttaacttcatttatttccatggtttgattctgttatgagaaacaaaacagagaaagaaattaggatatttggaagaaaactatttaaggctccaatcgctctgggttcaccagaatctcagaactacagattttccgagattcttacatttcaggatatttaaaaactagggtattttgacaagacttacatatttgtgaataaattcctgtcaaaagctctcaatgacatatatgtagatgatagcaggttaagttatatttatttcctagagtataggacctgagctggaaactcatcactaaccagcccagtgaaaaaggacaattgtgtaatttagaggatattcatatcaggtttctggagcaaatttaagatatgcaaactgtttattatgactggaagaacaaaagccaaggaactaaaattattaatacagagaccttctgagctcctaggactatctgagaccatgtatttctaacctctgacaaagacaataaactaccttgctctttggcacacacctggaactactgttcacaacacacaacaatcacagctatcaatcgattattcctttccttttattcaagaaacattgaaaataaagggatgataattaagggataattatttagattgatatagcaaagcaatgtctgtattaaattttagacaagtcttagatcttgtgtgtggctgcagttccatcctacagactatttctattgatatattgctgctgtctcagctgttgctgccactacaacttcagcagctaggcaaggcaataccagaataggaaggtgagtttgtcctattttcagagaaaatatagaatcaaagattgctgatttaggtataccagcttcatactgaaaaatgggaaactgctttaataagctctcaagtatctatcaagtacacaacttcaatagtaagagatcgaatgtttctctaatgcatgtcttctttggactaattctggaatgtgttctacataataaatactttctagctcaaactctttgaaatctgaatctcgtggaattgctacaaagttgtgctatcttgttttaaattctaatacctgacatacgttaaagagcctttaggttgaataaaattcactgaattttagatttcaatgaatttacaaaaaatataaatttattatattttattaaatataaaaatataattatatattagtaaatctataaatatactatatacatcatctattatgtttcattatattatctatcttatcatacatacttaaagttgaaaatatattagcctatatgtatgcacagtttagaagttcccaacttatccttcacaattcattcttaaaatactaacatgcacatagataatgccactaaatctccctttaccccaactgtctcaatggaaactgtaataagcttaaaaaagaaaataatactgagaaataaattcaaaacctaaactaaaagctaaaatatctatttgtatagatgtgaacatatttttactaaggagattgtgcctatttgagctaaaagagatatttaaatgagttgataaagtttggcctcaaagcaactgcaaaagtaaattgaaatgacacaataatattggtttacaatgaaatggttattctgcaaagagtaatatcaacatggaactagcctttatgttgacctatgaaaataaatgatctaggaatttacttataacggctatcacagtgaaatggaccctacatttaacttattgaaaacctatcacagggccttcactaactctccacggtgacatctcagcttagacttcattctatgcttagaaagaacatctgaatacaaaatatttttcagagtgatgaggttgtgtgatttctaattggtctctaatttataattttttaaaataacgttaccattttcattaaatatacttgttctctcactttattttcctaggtaaaaagaacaaacactgatctcttaagtagagcagccactcactaggggatggaactgggaggtctggtgaaggcccttgtctaaacacctacccccacccaccactccaatgaacaagccttaaacttccacttttagaaattcattcttttagtgtaagtcattgaactttcttaaaatctaagtatcatttagagataaaactcattatgcatcctgagtcacttatactttcaagtatgtgaatgtatcacctattgatgcagccatcaatctctaagagatagaagcaaacttgagaaaagcccagaatagccaagaattaactttgacctactcaaaaatgtgtccaagaatgacccaggaagactatggttgtttactgttattttaaatctctcactatctttagaataaggttcaaattcatatattatttatagacttatgctttaaagctgatgggaaatagtgtttcccaagctggatgctaagctggatattgtacaaatatacttctatttaaagacttgaactgttcctggcccaattaaatattaacaaatcagcaaaagctatataccattacttcattcacctcaaattacataatttgaaagtttcaaggcacattcatcttcaaggcactagctacagtgatcaactgaaaacggctcctcttcctatgcctatttctgaaattgtaaaaatggaaatctgtgaatactttgaattttttttaatttaaattctagtgaaagttttatcacgtaaaaaatatataacaaaaacatttatccaccgccatgtttaaaccaatattaagatttccctatttttgtttccaaaaagaaaaaaaagggaaaaaaagtcatatatatacataaaccctcaagcctccatctttttccttcctttctacctagggataaaatatttttttaatgcataggtataagtcccatgcatgtttttagtctttcactatacatgtatatccacaaatatgcaatactgttttctgcatttaaaatttcatagaaatggtattatactgtaagtgtgcctctgaaactttaattactcactctaatttccagattaaccatgttgatataaataaataaatttcctcattttaaccattgaataatgttttactaaataactgtatatcacagtttattttaggcattaccctactgaggagatggttaaattgtgttcactttttccctcatttacaaacagtcctgaatgaccaactctgtacaggcctacttatacacaattgtgagagtttccttacattgtaaactagtaggaaaatccttgagtatatgaatgaaaattgtcaatttttctaggtattatcaaatggttttcaaagtgactttgcaaatctatactcctgcagaaatgggtacaagtttgtttctccatgctttccccaacaataagtgttacatgacattaatattaatattattatattatatataattaaatgtaaacttgtgatagtttgcattattatatgtaatataacaacattattatatataatatgataacaatattatatatagtataacaatattatatatagtattattaatatgactctttaataataatattggcagccagtagctgccaatctaatggatgtgacctggactctctttttgtcaacctgcattttttaacattactcatatcattgaacatcttttcatataattactgacaacttcaatcaattcttatgtgatagttcttatcctttcctcattttttctataaggacttctgtctttttcttatcaatatgcagaatttttgttttttaatagcctgggtacctatccttcacatgtgatattttttttctctcaggctgtggcttacatatttacatgtagcatattctttcttcatggtaatacaaactttttttttgggggggtgcatttatttggttttttttgtatcttaatgtggtaagttctattaattttttactgatggcatctgttttttgtgagtttttaaaacaaatatatccttcattaccactatatcatacagatactcttctataacttgttgtaacttgtttctaaaagctttaccattttacttttcatatttagtcttttggggtaaagtttcaaatagtgtctgttttatctttttccctgtggataaactaatttatcatgtattcagtggtccctatttctattagtttatgataccacctttaagaaacatcaagttcccacatatgtggatccattttcagtgctctcttctattctgccatatcagtatgtttccttttccctgtaccaataccacattcttttatttaccacaagtaagtttgggtatctggtataacaattacactccaattccgctgcttctcactccattcttcttctttttaaaaattatctttgctatttttggcccttattattccacataaatcaacttatctactgaacaagttcaggatgccatcccaaaatacaccatttgacatgttgatcattttgagctaaaggcacctgaaaaacagcaggtgcaagagatgcactctgattttcccttttcttcataaagcaggagttgaaactcccataccttccctataccaggagaagagaaatagtctcatcacaagaggaggggagttaaggctgaaagaaatctgtacaaacagaccttcttaaactaacccctctcttcctagtcacttttctacaattgccactctttgttccacatagtatgtaagcatttagagctagtcatttctttgggtctccatttttcttgtgagagcattttgtttacaggcacatgtaaataaaatgtgtatgtttttctcctgttgatctgtcttatatcagtaccagctggagaccacagggggttagagaaaaattttaccttccctacattatcaagttatatgaaaacccttatggtattttgcaactaaaattttattgaatttatagattaatttggggagacttgtcattttaaacatactgactcttacccatccatacagatatagctttcaatgatactttaaaattttcttcataaaagatcttctacaacctttattagatttcttctcaattactttacattcttttatgtaatttctacatggtctctttttaaaattacccttcgtaactgtatggttaggtgtataggaacacttaattttttatattgatcttgatctagcaacttttgttgatattgaagattgctctgtacattctcctggacctctgcaaatattgagaatttgtttcttcttttccagtatgaaaccttttaacagtgagcattcttctcttcttccttaatttaaaggaaatgtttctaggtttcatttttaaatattattttttagagtttttggtagttactattaagtggtgttccttttattctcatatgctatgagtttatatcataaaagaccattcaattttatcaagttatttctaccaacattttttaaactttgaatataaattagattcaacagtaactagaaagtatacattaatatatagttaggtttttagataacattcctcaattaatttctatggagcattctcatcttactagatgttataggtggtttccaggatcaagtcggtttgggaaatgctgtgaactgtatacctccttcttagcaattcacaatatatgtcattagttttgactctgagatatcctacagtgaaacagtatacagctgattgtgtaacaaaaagtttctcaaattcgcttgatcaagtaatttctcttttctcagaacaacttactggcatttccagggcactactattccacaaatcactgatagggagaccttgttttggagtaatttcaagagtcataaaaaattattacacacctagagaaccattactcccattagtttctctgaaaagcctaatgccagaaacagagaaaaagccatacttgtgccacatcaccggagactgaagtcactgaagaatttgctcctagtttatttcaggtactaggcttctaagtatgtatttgcatcaaccttctctacaattgctccacttcagtcatttgctcacagtagtacaaaaatattaagaacaaattttctaagattcacagatatggatcgcaactcaatttgctgtactagttaaatttagtctacgatttctatcaagcccccagcttttactaatcaaaagacaagtgtgttggctgtcatgacagtattgtacaaaaaaaagacaaatgtcaagagccaagtatcattctattatacactaaaagaaagtagtctgttacttgattgacattttcttgtcagttgatgaatcttgaacaaatcacaagcttgggctgggcatggtggctcacacctgaaatcccagcactttgggaggccaaggcgagtgggtcacttcaggtcaggagtttgagaccagcctcaccaacatggcaaaacccctgtctctacaaaaaatacaaaaattagccacatgtggtggtgcacacctgtagtcccagttactctggaggctgaggcaggagaatcgcttgaacctgggaggtggaggttgtagtgagctgagattatgccactgtactccagcctgggtgacagagcaagactccatccaaaaaaaaaaaaaaaaaaaaagacatacacacaagcctgtagaactcatctctaacttgaaatatttcctttgatatacttaataaaattactgcataaaagtagtaacatccagcaaagtgaacttagtgatataaaggaggacacatggtaatgagcagaatgtttagctttatgtgtttctaaaactgaatccctacaaattcatgtttggtgccatttaggaatattttgcacaccaaaacaaaaacaacccaatgatacagttatgaacacaaaattgaacaagtgaatagtgttccaagctctttgtgttccaattattttcatttaatattgggaattaaatgtttgaaggaattcccataaaagattacatctttctgacctattttaccttttccaagttttaaaagcgatcaggttcaaataaacattctagtgttttgctaaataagccactgggatatgttttttctgtccctctcagaacagcaattatcatcacaaattaagagggaaaggcagatgtctcaaagagcaataaattttaatttgtgagtagtttatattttccagaattctcttatcttttctattcatttataaaatcaattagaaacagtatcaatagccaaagaaaatgtttattaaaaaaataagagaaaaatcctacttgcagaaaaactttctttgctggtctctacccaatatgagtttttaaaatgtaggtgataaagtaagatttacaggaaccttttggataatctcgtataatcaacttttatagaatgctcatgattgaattcttaaaaaattccaggacttggtactgcctgaagcttgagttataaatatataactcaactgtacttttattgtacataagcaaaggaaaaataaaatctttatctccaaaagtgagtgttaaggtaaaggcaaatacctttttgtgaataccacttgaaatgattctactaaatctctattctctaattttaaatagcaaagatggtggagagagttgaattttcattcctaaaatctttgattactggagagagaattgttcgtatgcttaactatttttatttccttcgtaatagtcttagttaaataattaaaccttaaagctatacttacagaattatattaatataactatattaaagttagattgctgacctcaattataatatagacctaagagtataacctactatatcacagttatttatgctgttaaccattagatatatcatgctcttgagggtccattaacttttttcacaacagtcttcaataaaattaatactgttaagtggcacaaggagaagacttaaatttttaaagcaaatctatgggaattatttttcaagcagaatagaaacaaaagatgtacataaatattataactgcccaatgggttttctttacctgctgcctagacagagaagatttaccaagagagggaaattgcaatagagagtttaattcatacagagccagctatttttattgttattcaaatcagtcttatttgagttgtattactacttaataataaagaccagagttttattattactcaaatcagtcttccccaaaacttggggatcagggtttttaaggataatttggtaggtagggtgtcagaaagtgggaagtgctgattggtcaggtcagagatgaaatcacagggagttgaagctgtcctcttgtactgaatcaattcctgggtggtggccacaagaccagatgagccagtttgtcaatctaagtgatgccagatgatccatcagtgcagggtctgcaaaatatctcaaactatgatcttaggttttacaatagtgatgttatcaccaggagcaatttgggaaggtttagaatcttgcagcctccaactgtatgactcccaaaccataatttctaatattgtggctagttcgtttgttagtcctgcaaaggcactctagtccccaggcagggaagggttttgtttgggaaagggctgttttcatctttgtttcacagctaaactataaactaagttcctcccgaagttagttcggcctatgcccagggatgaacaaggacagcttggaagttagaagcaagataagagttggttaggtccaatctttttcactgtaataattttctcagctataatttttgcaaaggtggtttcaagaaaattttgtcactatatgcttttatctaaagttagacaacattttagacaaaaggatatagtgacaaatttttttgagaaagaaacctaaatactactaaatattaagaaaaaacagtgaaaatctaaattaaaaatgaatgaaatagataacaatttaacaatatgctaacatctatgctcaagtaaaaaatggagtgataacaaagtaaattcaagataaacataaactgttaatgaataatttatgtgattatttatatagcttcacgtttgtcatcttgaaatttccctatgtcttgcatcctttattcctgttaaataaaatttataggaagccattgatttggactgagatcctgtactaggacccaacggaatagaccaaaccaaaatggagtccctcatactaatgttcagaaatcaggagagagatgatagccaaattctcaaataggccagttctggccaacatggtaagtcccctctgctttaacccagtaacctgaagtaacctgatattaaccaatttgcttttcatattatgctgttttcctgttcttgctcaagctatcttataaaaactgaccattctaccatgcccttcagagcaacttttctaaatttttcagtgagatgctactcaattcgtgaattgctattaaaagccaattagatctttaaactaaatttgttgaaaatttgtcttttgacaatcctcaaagcactactttgaaacagaatggaaatgaacacaactggtagttaactagctaaatacgtatgattcacaaaacactatcaagctaactctaaaaatttaaggcccccttgggggatggggaaggaagaaacctctaagatcactgttctcacttttaacatctagttcaaaccctaagtttagtcacattttattatatgggatcccaaattaaataaaagaataatgaagccaagtacctactcaaagcgctgatctctatgggatctaaaacatcacctaaaatgtaaccgaatagaaagatacagaactcagagagactacagaactgataagaagctggaaagaatacttagctaagtagcttgaagttgaagattaaaacccttcaggctcctataaccagaggtgattgattagaataatactaaattatattctaaggatcacagagattttaactgtgaaattttggtttggacaacagagttgcaaatgtaaaggcaaagctacattactcatgatagcagatgacaagccgagttgctatcaacagttctcagataatattaattgttcaaatgtctagcatttgaaggggtcacaaatcattagtctatttggggatggccacaggtcttgttggccatgatttacctgtgccaccagttaaagggttctgattaacaactcagtagtagtaaccaaatttaagttgcatttttaaaagtactcaaaggtatttcccatctctaatcaaataccaatttttggtaaagaaaatcaacaatcacattctcacacacacacacacacacacacactcacacattttaaaaaaacgccttctaatagatttagcaattcagaatcaacacatcccactactgagagcagtaaacatactgagaatatttaaaagtgggaatgcattaaaatcctcttaagaagactggtgatttgaatctgatattggccatctataaatgctaaaaagtatcctcaaatttcaaaaaaaagctaatatcaaattaaccagaaatgggttattgtctgaccagattatttcagctgcttatgaaagggcatatttagatgcaaaagcaaaaaataataattttaacaatagaaatcataatcacagaaaaaaaaatcccactatcctttcaagcagaaccaagtaatcccagcaaatatactgacttcaaaataactggcatattctcaatatgaaattctgtgacagaaaaatgatcacatttagcatattctgtttcatccaatcagatatgatgcccaattgtattaccagtgcatattttattgaatatgcccattattacaacatattaagtacaagtgaatattttgtttctggcctgttctccagaaacaaatgttaagatgtaattggtttacatatgcaaggataaacaggctgaaatacacataaaaaacttcatttccaaacttcacttaggtaaatataagaattacatacgcttactcactttaacgctacttctataaataccactactaagcagtcaggaaggaataaacctaggctctgcacctaaggagctcattagagataatcatctgcggtaggctgtgacaaaataacagaggtgaattttcaatttaattactagtaataagagagtggaaaggtaacttgtgatcaaaattctacagatcaagttgagatattaaggtgatattcaagaaatagcaaataaagcttttcataaaaacatcagatttactcttctaattcagctacctaaatataattctcactgattgttccctattcctaccctaaaaggcagagaggggatattattaaaaacactttacccaggaacctgaggactgggaaattctacaaccaattgtgtcactaatacaatatgtaactttgtctaagtcacatctccagaccctcgtttcctaagctggaaaatgagagtgttgcagtaaatgaataccaatgttcatgtggggacccacttgggactccatggttggtataaattttattttaagctgaagacatctgtgattcaacagatacacaagcctcttcagagtttctcttatctgaataaaagtaaaagcaaagacttctaacaaatgaggactgccgtaaattatctctttgtggtggcttctaatcccagcagagagcccaaaagtaaatttatcataaatcctctatctgggggcattttctggccctaagacgatataaagaccacttgtactggtgcagtcaaacattgtaacaaatgttatcttctgtttgttcaccaaaaataacccacttgtctttcttaaagaaacctatttgttcttcccacaggagccttttctccccactgcctttcccctactaagttaggaatataaactccaaattctaatgatccctttaagttactcatcacttagcacgcccatgtatatgtatgttgcatgcataaattcatttttctcttgttaacctaccgattgtcagtttaattcacaggtttccatgtacaaacttaagagagtatagaaaaagttttttgcttttcttccctacattaaaccttcaaacattcctccaaagttctcaaatcctaaaccaaaacaactaaaaggtgaaaatagcccatcaacttatttgtcttcatgatgccaaataacttaaaagagtaagttgtttggaaattaaattgcttaaattgacctctaatttgatatctcatatggaatggcacagtacattagaaagtttactaaagcagtaaaacactgaaaatctaatctaatcaaaaattattgctgggtctcaaaaatgctcctcttccctcctcagattcagaaatggagaaataaaacaatggagtagctgactgaggccaaaataatacttataaagacaatattaaagtacacggctctttatttatatgcaagcaatgtgctttcttaataccgaaccctagaattatgcaggattattaaggtgaacatatagcttattattccaactggggtactcaagggagtgaaatatggtgttatgaataatcatattggggacgacatcaagtggaagtgtcctgggcaaaacaagatgtacggtcatgcagccagaacccagctttccctctgcagagttgaaacctagactctagttcctctagactacagagcccaattggtgctccttgcagttaagcctgttccaaaaccccttgcctaatacattcttcccaaatttatcaatcacgttaagctatttcaccttcaccaaagcagagatgaaggggaagtgaagtaggagagagagagagaaggtcactaattgcactaattaaggtccctttaccttgaaggaaatattaaaaatggggaagaatctctttctctaacgactttgtaatttattatctctgagctagacccctcatatacaaaatgaaaataatactataactcttaagaaagagttgttttgaggattaaagagaaaacacatataaaattttttgagtttcaaaaaaattacaattgctttattactttattaatcattaagattacagtgtctaaacacaagcttactgaatattatttcatgaatttctttaccaaaaataactttttttttttttttttgagacagagtcttactctgtcacccaggctggaatgcagtggcacgatctcggctcactacaacctccacctcccagtttcaagcgatgctcatgccttagcctcctaactagctgggaatacaggcgtgtgccaccatgcctggctgattttttatttttagtagatacggggtttcatcatgttggccaggctggcctcgaactcatggcctcaagtgatctgcccgccttggccacccaaagtgctgggattacaggcatgagtcactgcatccggccactttactaaaaataattgtaactacttttcctacaaagtaaaataaatcagtgaggtttcacgctatactccttatctgaattgggctaactggccagtgttgaaaattataagcaattaacaatttcaaaactctgcaaaaaattatatgtgtgtatatgtatacatatatataaaatgagcaaaattataccaattgaaattatacatttccaataactgtttgactatgacattactcaccataaaagacataggtagcattcaggcaacatacaaagaatggggtagaaaaacactgaaggatactaaatttacaggattgttatcaaggttaaagtatttttaaaaaccttctgtttctgcaattaatatttactttttctttatgaagtgaataaattttattaattgccttttcaatacctatcagggtaagacttttgttatataacatattgatgttatattacgtattacgttaataaaattcctaatgttaaattagatttgcattcctgatattaacactactcaatatgttatttcatttgctcttattttggattctgtgtttattcatgtgaactgttaatattttggaataaagagactttcttcataaaatgaaatagaaatttttctacttttcgtatgttttggattactttatataaaactgtgggcttcgacaacaaaatgaaaatacaaatttgttttgttaattatttgttattgaagtctttaaaattatactttttttctttttacgattctcggcatattgttttactagttactgtatcgttttcactctgaaaattatgtttggaattgagatgtatactttgcttaatacataaatgtatacaatattaacttataacagttaatattttatctattattacatggtgctttcattttcaattaatctattaaaatatgtaagaaatattaatgtatttaataaatatttaccgagcatttactgccagccaggtacatctatactctaggcataaagcaccaataaagtagaaaacaaaaaaaaagcctcccaatctcttggatttttagtccatgcctttggttatttgtttattatttgtttgaaataagcggcttttggttctactgtaaatacttttgattttttcctattatttgtctttgtattttgttctttataagttttcttcttgctttccttggttaatttctgttatcatacagccttaaggtaacgttagataatatcttttttccttttgttattaggtcatttagcacatacatttaacactatgataacttttctttttataacagcttccaacaatatatatattctcctataattttttgttttaaaatttcttctttaaccaatacagtggtcaaaattctttgccttttcaaactttgacatactaaatctgttttttcattcattttactttatctcgcatttagctataaagatcgttttctccattcagcgatttaatttccaaaggatccatttctcagaaaatttaaaaatagatatgcattaaaacccattttaatttaataggcttaagatgtgcaactagaaatgcactacatcaaatgaaaataaactatgtaagaattctgaaaatagattgtgggaggaagggtctcagattgagtagcatcaaaatcatgtgtatatataactatgtatatatcttagcaattaagctaaaaaagatgaatgcccacataattatgtaaagatacacagtttactactaatagataaccagcaactatttttgcagagtggaaacagggtgtgaaaaagaatcttttcaatttcattttgtaactctagcctatcgaattttattaatgaaaataaattactcctaataatataaaatatactttaaaaagtgaacgcactctgttctatgtcaaatttactttgcctataaaggaacaagtccctctggcctttctaagccactaatgtaaggtaaacctctcttgccctaaatagttcacaagtagcttctagttgatgctaataggtttaatctgcttataacaaatcacttataaatgtattatcaacaaacctaagtatatttaaatgtactatcaacaaacctaacactaaattatattttagtgttaataacaaataccatggtctgtaaattaactactgtaattaactggatttagaaaaaaaaatttactgagtttcattcttctaagttccaatagtttcaagtccagtaaaaggaaaaatagtctttatgttaaatggacactaaatttggagatatatatataccatctaaggaagtaaatcataccatatacatacatatatatctgcctataaagtagaaatcaaaaccaaattaacatttgaggaaagtggtgcttctgcaagatgtttgaatactatggtcaacaacagcattctaaagtgaaagcatagagatgaaacaagttaaaaacctgcccctgcacccagaacttgtcatggatctagataaagatgaaaatatttaagtttattgagatccttctttatgccaaacaatgtgctcagcacttgtcatagatttcctgctctaatccttgcagtaatcctctgaggtacatattatattactcctccaaaattaagtattgaaagatgaatgttctgaaccctattgacttactggaaaattcaagtcccaaaagcttttactctcattagttttgttgtacacatttcccctagacttagaaaatgcaactctattcacgactttaaagcactttctgactgcctccacataagattgcttgttttgcttgggcttttttttttttttttttttttttgagttggggtctcactctgttactcaggctggggtgcagtggcacaatcatggctcactgcaagcctcaaactcctgggctcaagtgatccacctgcttcacccaactgagtagctggggctacaggcacacattaccatgcctggctaatttttgtttgtttgtttgtttgtttgtttgtttttggtcaagatggggtctcactatgttgcccaggatggtcttgaactccctaggcctcaagcaatcctgccacctcagcctcccaaagtgctgggattataggtgtgagccaccaagcctgaccacgactgcttgctttttatgtgatgttttatgagaatactagtgatcacatatcagcttattaggtaattgaattaaactacgagagatcacactttcactagtacagaaaatatattactagtcaaagggctgcacatttttttggaaaacaattttttttgaaacccgatacagttctgaagttttaaccgctcctcttaatataaggaagtatagctcactcactttcacatgagataccctctcttaacaccaaacgcatattttcttagaattggtgtttaaatagactttaaaagagagaggagaccctatgtttgctagaggtaattgatcaactagtctccgctcatgtgttctttcttgtgcattattctgggctatgaaataaatgagagataatgccatgtatgtagattgaaggactccatattaataggttcattctcacaaaattaatgtagagattcaatgccattcaaagaaacatcaggacaggttattttttaaagaaattgacaactctctgtaaatttatataaaaatgaaagaagctcggatagataaaactagcttgaaaaagaataaaattcacttcctgattaagtgacagtaaacaagacaatgtgatattggcataaggatatacaaatttatcagtacagtgtccagaaactcactcacacatacatagccaattaatttgacaaaggcaccaaaataattcaatagggaataatgatgttggaacaactggacaaacatgaaaaaaaaagaactttgctctttacctcatattatacacaaaagtaaattctaaatgaatcaaagactgaaatctaaagctaaagtaaatcttctagaagaaaacacaagaggaaattctttgtaactatgaagcaggcaaagattacttaagaaagagaaagcagtaactatgaaagacaaaacaaattggacttcaatcaatattaaatatttctactcatcaaaaaacacactactagagaaacgaataggcaaaccacagtctggaagaaaatatttgtaatacatatatctgacacgaatttgtatctggaatatacaaagaattcttagaaatcagcaataaaaatccaaataatgcacattttttaaagggcaaaagtcttaaatacttcaaaagaaaaggtatataaatggccactaaacacattaaaagggacccaatatcatttgtctttagggaaatgcaaattaaaaccacactgagataccagttcacacccactagaacggctaaaacaaagactgacaataccaaatgctggtatgatatacagcaattgcaattcccatacattgctggtaggaaactgaaatggtacaaccacttgagacaactgtttggcagcttcttaaaaaggcaaacatacatcttaccttacaatccatcaattctactcctaagtatttacccaatagaaatgaaaacatattctagtacatatatgctcatagctggtttattcataaaattgctaagaactggaaacaatctaaatgtccctcaacaggtgaaatggacctatattgatataataaaatactactactcctcagccataagaaagaacaaacaataagtaacaacacagatgagactccaaaaattatgattgttctattccattcacatgaagtccaagaaaaggcaaaactaacatatggtgatcaaaaccagatagtagtctgtagagtgggaggatgttgggggaaaactgaccagaaggagcatgaaggaacattctgtagtgctagaaacattttgtattcagtttggggaggtagctacatatgtgtatgcaactgtgaaaatccactgaatacatttaagatctgtgcattttattataagtaagtagtttctcaataaaaggtattttagatttttttaaggtttgagctgtggtatcagaaagaactaggttcaaattgtgatgcataattttttatctttgttaccctgggaagttccttaccttctcagtcccctagttttcttattttcaacatggaaataataacagcacatatgtcacaggattttagtgaagatcaaatgagataatggataggaaacacttactacagtgcaagagagtctgcttagaaaaccttcactattattaattcattattaataaaagtcttccaaagaacagtcctaatacaatcacagctaagtacacatgcaattctctacctaaaactaatttcttgccacagtagtttacaacaaaaaaaggctcttatggcattgtagttactgttttaaaaaagtgatatttgtaaaattgcttttaaatggacaatggaaagacacaggattgcatttgcagccacaataacagtggattatatattaacaaacaacctcccgcctaagtcatcatcatcgtctctttcctgcattatttcaatagtctcctaactagttccacagttcttacatctttccttagcctattaccctagggaatccagaacaattttttaataaacataattttgatcatgttatgcctctgcttaaatttggctgaccatgctctcttaagataaaatccacgtttctcaccatgagccggaggaccttccatgacatagcttttgcttaccaatccaatttcagttatgctcttccaccctcactaagtgaacatgaactacactgggcctttcctttgttcttccagcatggcaaattctgtctaatttcctgacctttgcacttgccatttcttttgcctcacgtgctcttttcttgctggctgctcctcttctcttgagtctcaattcaaatgcctcattctcagagaaacttttcctggtcaccctatccaaagctggtctttctgaatcaatttctattacatcaccatgatagcactttatctttgctgcactgaaagtctgtgtcccctcaaaattcatatgttaaatcctaatgcccaatttaacggtgtgtagagttggggcctttggaaggtgattaggtcatgaaggcagacctctcatgagtggaattagtgtccttataaaagaagccccagagaactcccttgccctttccaccatatgaaaacacagagaaaaggtatctatctatgaacaaaaaagcaggccctgatcagacaccaaatcaactagggatttgatcttggactttccagcctctagaactgtgagaaataaatcgctgctgtttataagccacccagtctatggcattctgttaaagcagcttgaagagactaagacacacgtattaacacccgtgcacatcttaggtatatgtttgttgtccgtgttccaccactagattataagctttataaagacagaaactcttttgttcacctggtatcctcagttcctaaaaaacagtaagtgttcaacaaagttgttatattaattaatgaattcataaggttgactacaactctttaacttttcagatggcattaacagcaaattcatttcaacaacatacttattgttaacctttttttctaagctcctcatttcatgttctgttcacttcttgttttcatgtcttgtgtttcaatagtagtttcttcaaaataatatgatgaattaaaatgagagtagtaaggctagaaagtctcctgagatgaaataattttatatccatagcagaaaggttttcctgtattttagagatattttactaaggtactcatagatagtattagccatatatactataaaaacatttgctgtaggtagaaagacatcttctaccaaactgcaatgtacacatattgttagtgaaacatttacactgaatatcaggttcatcaaggatcaaactacaaaggaaccaaaatcatttcattcacatagccaagcctatgactgagacattttccaccatacaaaacttttttacccaattcatggaacttatgattccttcacctggctatagaaaagaatgaaactgttaactgtttaaatcacttccctcacagcaactttcttccacttgctcattggttcaactcactgacttgactctccttctgtagagtgaatacctgacttgactttttctacctttgtttatttttatatcacctgtgcatacaatataccaggtaccacactttacatcttttctcaccaacttatacaacggctataggacttaccactgaactagtagagtcttgtaaccagaaacacaaagtcacttatttagcagttactgtggcatcacatatttcaaatgactgacttaaaaactgaaactcatataaccctcagattttatttgtcattcatttcaatattcaccaactgaatattttcaagaagtgctagcgaaaagccaaactgagtgactagcatttccacctctctcccataaatctgctttcactaaagcaacaccaaaaagcaaagacatgccacaaagtaaaaacaaagataatggacataaaatagaactaagggttaggagaactaagaaggtcaatgaccgcaggccattcattttataactctgtgtattagcattcccgggtctaaagaggcactcaccaaatcttccctaattatttctcaggccttataaagaaataaaatcacaattggaaataatgtcaaaaagtttgagtactattcaaatgatgctcctgctattactgagtttctaaagaatcaaaaattaatagtgtaatagatgaaactattttcataagcactatataacattatcttcattaaacaagttttcctatcattttatttcttgatgatgaaaaaacacttcaaagtataaaagataatctaagccagggttattgcttttttttttttttttttgagacagagtctcactctgtcctccaggctggagtgcaatggcgtgatcttggctcactgcaacctccgcctcccgggttcgagtgattcccctgcctcagcctcctgagtaggtgggactacaggcgcgcgccactatgcccggttaattctttgtatgttagtagagatggggtttcaccatgttggtcaggctggtctcaaactcctgacctcatgatccgcctgcctcggccttccaaagtgctgggattacaggtgtgagccaccgcacccagcctattgctctttttatatggccctctctcataaacttcattcccatttgttatgtccacagccgtatagagaagtaatatgattacagggccataggaaccagatctagttctatgttaaacactttctgggtgatgtgaggtgggtcatttcactcctttgggccggggtttctcatctttaaagttaggcaactagagtccagcaggtgtctagactcttgggacatcagcactccttcttttttttttttctttaagagacaaggtcttgctctgttgcccaggctggaattcagtggtgcgatcatagctcaatgttgcctcaaacttctgggctaaagtgatcctcccacctcagcctcccaggtagctggaactataggtatgtgccagtatgcccagctaagtttttattttttgtatagacagggtctccctatgttgtccaggctggtcttgaactcctggccccaagtgatcctcctgcatgggcctcccaaaatgctggaattacaggtgtgagccaccgtgccccaccctgcactcctttttaatgtcgaaacacttgcattgccacatgacagcagtggtgtttctaatattattggttgagctgttatgaattcagtaaaacttttaaacaaatttgactttaatcaaaatgatattaattcactatggtatcaattacatgataattcacatatttttacatattttaatcagcgtgcatgaattcaagacctctaggagtaattcaatgataagagtcctgcactcacaatttaggcactttataactacagcaggtttaagtcatcaaagaaatgtgactttttacatattatttaaataaaaggagctaaacgtgaattttctatagctcctctgactccctgaaaagttcatgcctattcatttagagttaatagctatctcatcttcatctatgcagcgcatcctatcaaaatatatatatattaggaatatagatatattagtgcttctctactagaagcactgtacaatataaatgaaaaagacttaaggtcagttatttcataatttccaaatgatttcaaataaacacagggtaaaaattaatttaaataagtaatggatataaagtaaaagagtttgcataggacagctttaacaaaaagttggcccctggagaagttttgaagagaaaggtgaggtagactagtggagagcttgaggggtgagagttgtatgtgcagagacagagactgaaatgataaagcaatgtgcttaatgactaatggtgatattcggcaaaccagaatcaggaatgaaagaaccatttaatgcagcttctgaaatgatttcaaaagaaatcttttgaatactttcctatgttcctgtaataacagttgccttccatttattaaaggagccttggtcctcagtgtcttttctcctgagtaagcatttttactttagttagttttaaaatgcctaggcatgaacaccacaaatgaaagatcaaagagtaactagatgctgtctaatttaaaaaactgtactcagcaagtgcaaatccttttttaattgctaaactgaacatctgggttttttctctacttcttttcagcctgtgagttaagtgagttaaatatcctcaaacaaagggaaaagtcaagttatcaggtataagtatggctccaaattaaataccaataacgttgaaattatcagaaattaatttgcctttctattgatgctttgatatcattgtaaaagcagagctatgaaaaagatatagttacttaacatgttttaatacaaagacaaaatccactttattttttaaatacagaaacatagactctgctcaagcatgtagcttttaaactgtgaaattacataaatggcagtttcttcatgagtaaactgtcatacatgtaactaattataatgagcctctttaaaaggtgattacttgacatctgacttttaaaatacatacacaaactaattttgctcatgactcaaccattggtaagccaaagggtaggctaaatatgtacaaatgagaacaggtttccattctgcttttaagctaaacaagaaaaatgttgtttttaaggaaaacattatttccatgttaaaatatgagaaggattctcacctgagttctgtaatagaataaaagaacagacattttgtttaaaattctcttgttgaaaaaacttttttttaaataataggggtagttgatgtgttttagctttgaactgagggcataaaataaaatctgtgcacatggaatcctaagaaacacagaagatgaagagtaatttaaaagctttgttctgaatgttggttacaagagattagttcagttgtttcaacttactttttttctccttaactctttctaaaataaaacattaaatgggcatgaaaaatctcgtgatgattttcatttgatctagttcagagtgtacaaatggaaaggaaggtcataaaaatacttcttgaatcacaatttacaaatttgcaaaataatattctactacattctaaggtagtagaatttttacattgttctcttttattcctatagtaatttttttatttatccacttcaaaaataatttttccaaatagaaggcatatatacaaattacttaacaagtatgtaaatcaaatagttcaaattgttcagtgttatctattgacaataagagagtgggaggtccaagcactaatgcccaagcagcttccttattccaagaaccagctgacagcctagttagactagttattaaaatgacaacactttcataatcaagatacaacaaatttgaaaggctgatgggaaaacattttactgtgttcatatttctctaaatgcaatatatgccttcatgttaatacaaagtaaaaaccaaaggaaaaagtataatatgaccattccacttaatcttctaaagtgtctcaaaaagttttttaaaccagttttactcctaagtttaggaaaatggaaaaaaaaaaaaaaagaagcagaaaaatcaacccaaatgatctaaaacattttactatcttacatggcaaacttctaaatttataatcaccaaatgagtaaaacagattccgaaaactacccaagacattttaaaaaagtaaaacacacacaaacaaaacacaataaaaacgtttgcctgtccaagaaactacaataccgatagcatataagagcccagttagaataatacacaggaaatatatataaaattctgccttttgcaaacttgtacaggcaaggtgtggtggctcacgcctgtaatcctagcactttgggaggccaaggcgggtggatcacttgagctcaagagtttgagaccaacccggccaacatggcaaaaccatctctacaggaaaaaaaaaaaaaaaaaaaaaaaaaaaaaaaaaaaattagctgggcatggtggtgtgcgcctgtggtcacagctacttgggaggctgaggtgggaggatcgcttgagcccgcgaggcagaggttgtggtgagctgagattgcaccgctgtactacaacctgagtgacagagtgagaccgtctcaaaaaacaaacaacaacaaaacacaatttgtacaatacacaactatgtataacttacagagatcaataaagtatatatggtgctttataatttacagtgttttcataataaatcatttaattcttacaataactgagagatgcacaggagaagggttattattctagctgtagtaataaaatgatgttcaaaaaattaaaacatactctagtaatttaaagcacagcaattttgtaagaaacagtaaggtggctcagaaatttttacatttaatgtgaacaatttggaagaaaggaaaaacaaaaagactagattagccagataaaagacaaatggcattaaagtatatttatgtaaatatattatcactgtcatctttgcaaatggcaacaaaaaataagaatttccataactttctacaaaagaaagtacctaatactgtgaacatcagataaaataaaaatatcctgttgtttatcctctttgttggagcatcagagagacttaaaaaggttccaccatctttatatgactattcagcaacgaaatatagacgggaaatctttacaaagaagtatgtaatctacaacccatactgaatttgaaatctaaaaccttcactttcaaatagaaatagccacctgactcactagtagaattaaaaaaaaaaaaacaacacccagtaacatcaccacaattatataaaagtgtattttatgttactgccatcttaaaatcagatcttccaagacatccaacttactccaatccaatttttagatgctattcttcaatgctggtatattttgaatacagttttactctatctagtgttagacactgagtgtacaaagaaacatattaaaccctatagccttcaactagttaaccccagaaatcaaaactgtgtatatcatacctcaatatttaaaatatactaatgtagaaaggcaacttactacaaaagttaatcagctggattttgtcaaagtttgtttctgttttgttgtattgcattgttttaaattgagtgaaacaaaggaagaagcggataatgcaatggcacgtattccacattaatatctttctaaattattactcataaaagttcaatcaagtttgcagattccctgcaagtctaggacattgacagcactccatatcactgcaatgcaatgtacagggcatttcatatttgaaaacataacaaacactatggcctttcattcatattaaaactaatatgataaaactagttaagtgaaaaataattatgaaaaacagatgaagggctaaagaaaaaatgtatactacaaagctaaaagtttaaaaaggcaaaaatatccctctggttcctcgtgattcattaaatcacattatcatacactaagaagtcaaaacgtaaatgagagtttagaactggcaatgtccagttcatcagaatatccaatatgcgcattatgaagaattccatctttcccttcaggtaaataaatacgcatcatgatgtatactccaacatctctatttatgtcatagaatatcaaaagtaagcagtctacaacataataatagtatttgggggtaaaatgatctagcactttcctgtgtacaataaagaaatcaaaattataaactttatcactgatatactttctttcttttcatttcatccaattagaatgttcaatttaataatcatatatacccttgtaaagacaaatctaaaaaatcttaactgttaacaaatgccaaaagatagaagcaacctgcatgtccatcaacagacgaatggataaactgttgtatatacataaaatgaactattattcattcttaaaaagaaataaaattctgacacacactacaatatgaaaaaaccttgaagatatgcaaagtaaaacaagtcagacagaaaaagacaagtagtgtatgcttccacctacatgaggtacccagagtagtcaaattcacagagacagagtgcaagggtagttgccagggactcgggggagagaacagggagataccacttaatgaatatagagttctagtgaaggaagacaaaaaacttctggagatagatattggtgaaagttgtacgacgatgtgaatatacttaatgccactaaattgtacacttaaaaacagttaaaatggtggattttatgttacaaatatttttccataatataaaaaatctttattaactgcatctatccttcactgtcctttatatttttgttaaggcataatagcatttttataatgctttagtaatcatttcatatcatctggttgtgaatctttatctttaaatatagcatttatttatcataataaaattggaactagatccaaaacaaaacatcaagctctctagtaaatgagaatatgcattgggaaagagtgaagagctctcatctgggtcaatgaatttaggcaaggtctagaatcactcatttttaatttttaatttgttctctccatctggaaagccatagtcacatggtaaacatgcgcctaagacaatgtgcctttcaggttccctcattatttctcacaacctcaaaataggctttttcaaatcacaataagttaaccaaattgcgtatggtcatcttgctaatgttagaaatcaaagtttccaattctctataaaagaagtgataaatcacagcttttatacagcacaaccccataagaatgagtgaagaatctaaatatgttctttgaaaaaaaaaaaaaaactactgtgagaaaaaactaagttagatgaaataataaactcctatctataaaatcactatacttagttctctgatggttctgcctaaagaagacctaaatattatacaagatggtctgtaaatgttcccttccaatccatcctccacaaataatggtttcatgcagctgtttaaatatacccatatgaaaacccacaagggagaaagaatgtgtgggaaagttaagcagtctcatgtttccagtagacttaccaacctgattttttttaaatgaaaataggatattgcacaatgagtgaatgcaaaaaaatatttttaatgtgttattatcctctttagtggactctggcaaaacataattctggcaaaacataactttttatggttcctgtatctccttcttaagaatcctgtctatatatgtatatatctccatatactaaatatatcactaaaaatataatgaaataatattagtatatattcaccattcaaatatcaagggaaattttcccaatatgaactttcccatgtcactgaaaattttgggggaagagtcaactgaaaggctttaaaaggctattaatccagcctagttttaaaaattaatcgaagcattttatgaatgatgtaatatggggaacaatatttactaactcacttggaaatatacatcaaattttaaatatatacaaaaataaataacacatcccaaaaatgggtttttgatttgtaaaaataaatattaactgtgaattcaaagattccttcaaaaaatgcaactttctttgttcttttccattccttactgttcatagcacttagaaccacagtgtaaatggaaatacttcatagatgtgttaatcttgttttgtcaggcagatcaagaaaatacaatgctgcaaaagaactgaaattcaacattcaaaatttcactggaaagaaaggcagggtgttgcattattaggctttcaatgaatcctaaatgtactcttcaatttaaaagattaaaatggaaacttctcactgaccatcaaactaaccccaggttttagtgaaagagaatttcaatctacttctcctcagtcctctgcccactatcaatccccagcacagcttcctaccccaaaagcaaaagcctagcaaattttatgccagtgtcataggctgtgggtatctgccacagcccagcaagtaatatgcaaaaacaggcacttgccaacaaaaaaggaacaggaaggggtggatccaatataagacttataaaactttccactcaattaaaagaaaaatagccatctacatcaatagtctaaaaaaagtctatgatacaaataaagctcccaagccaaattctttctagtaataattgacatgagtaaagagatcattcaataataggttgatgtttctttgacatgaaatagatgtttctttcaactccaggcatagctaatttaaaatcatggttaaataaaaactttcctacatgatataatacttctcatttacaaagtgaaaatggtcataatttactttcttattctgaaactcaacttccatgtcctgtttttttcaacttttattttagattcagggggtacatgttcaagtttgttacaaagatatactgtgtgatgctgaggtttggggtataattgaacccatcacccaggtactaagcatagtacccaataagcagttttttagcccttgaccccttccatcctcttcactccatttctttttcacacttcaaaatatctaaactattccaagtgtcttggctattaattatatgcacatgtgttataatgcaaattaatctgtttagtaataattgaatcctatactatagagtactatctcataaaatgtttcctttgtatttcttgaatgtgtgtatgtacagcatttcctccattcctaggtatatacccaagaaaaataaaaacttacgtctacacaaaaaacttggatataaatgttcatagcagcattactcagaatggacaaaaggtagaaacaatccaaaagtccttcagctgatgaactgataaacaaaatgtggtatacccatataatgaaatattatttaacaataaaacatgctatactatggatgcaccttgaaagtattatgctaaatgaaagaagccaatcagaaaaaaaaattgtatgattccactgacatgaaatgttcagaataaaacctatagagacagaaaatagatgagtggttgcctgggtttgagggagaggaggagaggtaagaatgatgaatcattgctaataggtaaggtgtaataaatctcacatttaagtcaagacctggactcttgatttcccattccaatcttagtatactctacttttccccttctcagttacagtgccaccattagatagttggtttgactagtagtcatctactatgagatgactactagatctaatgtagatcaatagtcatgcttcctcactttccctcacacctcacaacctttccatcagcaagtcctaaatttcctcctccaaaatccatccttctcactatttctaatgtcaccttcacatctcccctagactgcaagagtctcctaactatagtagtctcctcttaattcagttttgctttctgaggtttcagctacctgcagtcaaccaccatccaaaactgttaagtggaaaaattctgaaataaacaattaataaattttaaattgggtgccattctgagaagcatgataaaatcttgtaacacctaactctgtccagcccaggatgtgaatcatccctttgtccagtggatccacattgtttatgctacctgcctgtcagccatcttagttatcacagactgctgcagtaccacagtgctgtattcaagcaaccattattttacttagtaatggccccaaagtgcaagagtagtgatactggcaattggaatatgccaaggagaagccgttcagcaaaggaaactgtgcttcctttaagtgcaaaggtgaaagttctccccttaataaggaaataaaaaatgtatatgctaagatctatggtaagaataaatcttctatccatgaaattgtgaagaaggagaaagaaattcatgcagttttgctgtcgcacttcaaactgcaaaagttacatgcacagaataacttttattatagtatattattataattgttctattttattagtacttgctcatctcttactgtgactaatttataaattaaactttatcatatttatgtatgtataggaaaaatacagtatatatagttttgtgcaatctgtagtttcagacaccaactgggggtcttggaacgtatcccccagagacaaggggagactactatagtcttgctttcactcacacttccttacaatgtattctccacatggcagccagagagatattttttaaaacaaaatcctatcacattacttccctgcttcacatccttaaacggcttatcaatgcatttaaaataagatccaaattccttaacttggctaaaagactctacacaatccatcccctgcctacctcccaacatcatcatgtacttctctccttgctaattacactccagccacattgactttctttctactcctgtgcaagctcactgtcaccttggtcctttggcctggaatgttctttcttcgtattttctcacggtttgcttcttttcatcgttaatgcctcagctcaaatgcttcttcctcagctctatctaaagtaactccaatgaggtcattatctaatttatagccctgctatattttcttcatagcactgcatggtacttatctatccaaatgccttttcccatgtctctcatcttaactctcttcaccaacctaccccctgaatcaagaactgtgcctacacacagcagttgctcaataaatatttgttaaatagatgagtaaatgaatgaacaaataatgatgactgatataatgagggcaatataagacatgagagaccttgggaaccagagaaacaaagtccaagagttacaaaagtttcagcataaaaaatatcaaacttttccttattagataaaagctaataactggggaaggtacaaagaagatgtcttccagaactttgaagtctgaactcaagaaactgttttctttgtgaaaaatagggtggtagagaagggaaaaatcatgaataattagattttaaacatcaataataatagcaatgggagaagaaatgggcaaaagaataataaagtggaaaaaacatggtatgtaaaaagaaaaaacaacatcaaacacattctaatcacacctacctcaataacaattcttgagttcattttttttttttcctcaaggagcaaagtaaacctttgtagtaaacttagaaaagcaaattttaaaaagagacagactttttaaaaaaggtattaggaataccaatgcttttgggaaaacttaccaaaccaaaagccccaatcgtcacagtcactaaaccagagacatatagataggaatgtaagcaaggcacaagaaatagaatattcatgatgatgagccatattcaactttggtaatatgacatccaggatgaaccaatttatgttttcatagcatgtactacctatttctgatctatgataatttttatctataaatagtactttcctactgataaaaactatgtacaaccctgagccatcaaaagctgcctgtagagtccttagtttatgcagaaaaatggaatgaaattgaatcgtaataagggaaacttagattgtaaattacagatttcccaggtttcactttcaagtagaaaaagaaatatgttactgaacattccaaaatgacatcattctggccgttattcctagagaataaaattttcttttcaattttttgttttctaactgcctccctcacctcatctctctgctagatgcaacttggaaggaacataacagaatgacaatatcaaggattttgctattagctagtttgggtttaaattctagttgctctattattactagccatgtgaattaagaaaaattaatgtaaacaaaagatacctcttctccttaaatcttttaaaaatgccagattctctgcagtctcactttgctgagccacaggttctgggagccatttttggacactttggtgctagattcaaggcctgtacctgctaatgattcaggttgttactactactgcacaatgcttttggttgtctcctttctacagtctccaaagaccatccaacttctcaaccccacttctatttctcttcttctcagcagaactataactgccctcttctccacctcaaaacctttcggtatgtgctgttttctcactcttggtgcccgctgaggaaaaagaattcattttccccaagcttatctcttattctcactcatgcccacaacctcctcatctgtgcccaataaatactaccctctttctttgcattatcagtccttctcttccttagtctttttcctcttctttcaaataagctttggttttatttatccccaaagttaattcccttgacctgaggaatccctgaaattactcccaattctctttttctcttttatcttccctactttttttttttgagataagagtctcactgtgtcgcccaggctggagtgcagtggtgcaatcctggcttactgcaagctctgccttccaggttcatgccattctcctgccttaggctcctgagtagctgggactacaggggcccgccaccacacccggctaaatttttgtatttttagtagagaaggggttttcacagtgttagccagatggtctggatctcctgacctcgcgatccgcccacctaggcctcccaaagtgctgggattacaggcgtgagccaccacacccagccccctattttgttaaacaagcaagctttttcatgttatcgccatttgttccttaatcccaagaaagtcattaattctttatccttcagcaaacattaaatacctattttattttatgcaatgtgctaggttctgagcatacgaaaacaagtaacagtctaatgacccaatcctcgtgaccttgtcctaaacactattgaaattctgccatatgggaaatcaaggccttttcttggtcttcatttctctctacttctctacaattctgaacattactagccacccctcctttgcaaaaattccctccctcagaattcaaatcactgcattatcctaatttccttcatacctttctgccatatccttccatttatcctaaactagccctcttttcatccattaaaatgcagtatttccctacaccactatcctaggccctcttttctttcctttctatactctccattgttatcttatccactagcatagcttctactatcttctccgtgcaaatgaatcacaaaattgattatcatagccgcaaaattgattatcacagttttatagataagaaaaccaaggcttgagaaggtcacaagaacttggaagtggcagagccacttcttgaatcttggcaatctgatttcacagccaatgctggtaacctacacagtacattgcatgttctccagaggcacttttcaaggaccacacccaattttcaaaggtctttttgataagtcagtgtgaatatattgtgtatacctcaaatacatatcaattaatcatcttccctcatcaaaatcagttcttgattctcacttctcaactagttacacgaaaactaattctccccatgactcagctttgaaacttcagccctcctgccacatctgttattatcttaaggtttcagaatctcagtgtctctcataatccaggccaatccatcgtattcattcactgctaccaagtaacatcatagaggctctctttaatgtgtctctggtatacttaagagcaaatttgcaatttggtaaactacctttacgtgtttttaaccttttctttcctgatttcccagattgtctatcctttgcccaaataaacatttttggttcttccctaaacattgatactttcctgcattcctgtgtctttgtccttctttcttccttctatgcactgccacttctgcttcctcaatgttacctttcttgcttctgccattaaatgtcatcactaggctacactgaattctcataatactttcttctgatactgaagatacatatatatcttccccataattatctatgtatgtctcctattcatcaaaccagtttgtaagttttttgtgggaactggtcatatgttattatcttcatgtcccccacagcttactttcgacaggcataatacaaatagtttttctcttctaatatcttttagataaaatgttaacctcgctttctttcctcattaatagtagatataggctgtcacattcctcaatattaatgttaagctcccaaaggtatttgcagaaaataagtgatgtagcgtttattttcttggagataaagcaggatataaaatgttttaaagatagaacatttttataggaataggatttctgacccagaaagctggccaaattccaatccaggtaattcactcctgttcccctaatccttctgggatttcagctggataacgctgtctcctccattctctggcccaggaaggaatatgatgtaccctacaaaacagctgcaacatgccacacggggatggcaggccttacagcactgggcacaggagtctctaaatgttccttacccacactccagaagtactacagaactcaattaggaaatgtctgaaggtctttgaatgaaagatgctaaataagcattagtgttagttacaataattttccaaagactcatttctcatgccctttgcctcttttatcccctaagcttgttatagaagggctgaataaattatttgcattcagggtgaaggagaaattatctgctcaaagctaagtgctgtttttaaaattgaccttgtgtgtgttcactgtatatttctaatatggtatttctaagtttagatttatttggtttggattatttcaaaacatataccttaaaaccttctatctgttttaaagtttgtagaaggtcaacaaatattaactcaatttctataaatcattattattttaaaagttatctcaatgatcctttagccacccctgttcatgcctcagagcctctttattattttatcttattgggagattatggacattatgattatcagcactaaatggaggatacagtgttgcaggtaacccaataattggttctctgtcaatataagacagtatatatttttttctttcaaaaggactttttaaaagttaacaattaaatcttgttttcccttttcctgatcacacagatgcattgggtgaagggggcaaagtcaacccaaggaaatttttcccaaaaataacttcaaaagttacagaaaagtaggtctcaatcctatctataggaggtaaatagtcctcgttgacaggttttatttttcttctctaattctattagaatgaaaaatggcctgaaatcaggagatctacatttaaggaacaggagtgactctgatactaaaattctacttgaggtctggaattaggatttttcccaacctgcttactaatgattataccaaccctgagtcactatttttgaagtcaataggctttctgctctactcccaaagttcctacatcaaccaaaaaaaaaaaaaatctaccattaataatatatatatatatatacattgagtaaaacaatgatcctttttaccccctttaaactacaaggcaagcagtcctcaaaactaataaaaatagcaaaatcttacatattaattttttttactgttgctaaaattcttctaacagggaaaaaattgcatggctgggccttgctagggaggctaaatatttaaatcgaagttgtcttctaagtgaatggaagattgtttcattatataaatcatgggcataaagaagtgactatttccctactaccagcttatgccaaattataaactatatcacagaattaatctaacagaattttgaacttttttttttttttaaattcaataggaaaagcgtatgcaaatcttactgctaaaagttctaggtcctcaaatgtgtattcattaatcataagatgatatcatttgggaatcattttattcctttatgttttcaataaatacctgtggtgggtgccaaacactactcttgacaataggcattcaagcagttaataatgtcagtaccatttttagatatcttagttttggatttgagcagaaacttatgaacttttttaaacagtcattaatccatattgcaactataggaactaccttttaaagtactagccgatttttaaaaacaaattctaattatcctcccgtcctttattttctacttagtcactcttaattttttgtattgccccaaggctcactaaaacaaaatatgaggtaggtaagaggttaattattcctctcttatcacctgttcatttcaagtaactcagtgttgtaaaattctacaatctgccttatttaagaacctccaacagctcttgccatacttaatgattcgttggaagaaaaaactcccattcttttcacccgtttttgcatgtttcatgaaactctatacctgataagtctatcaccaagagttagaaagtgcttttctcaagttcagtctttattggtacgttccaatattctggcttctcgtgagtattttttcaacatatactttgaacttgttttttttcctacctatctctcagttcaaaaactgattcttttggaaatccagttcaaacatcagctcctctaggaagttttccctgacctctcatcaacccaacagttatctcctacacctcagaacccagtaaacactcccattgttagatttatcaacctgaatggtaattttacttgactttacatctgttcaccttgaaaggagggacttttgtcctttgtaccttcatttatccagcacctagcagaaggaccagaacatggtgaataagcattttttgttaaattgaagttaaaatttagaatcacgctccttaaaattcaatttctcgctcgcatactttgtcattggtggaaacacacaaaatttacaggaagtaattaggcaagaataattttgatgatatttaatcctctaacccattaattctcctctatgaatatttcctaagaaactaatcagaactataaaaaaagttatacaaaagaatgtctataatagtgccagtcatcatagcaaaaagcaaaaattaaaaaaaatactaggaataccaaaataattaatcagttttctagtcacttagtgaagtataattcacttattaagaattcaaaagatttgcagtacatagggaagttttataattttaagtaaaaaagcaggacataaaattgtaatattttagtccagtattctgaagaaaaagaaagtgacaaaatgttaacagtgcttgtttgggggaaatgaactacaaatatgtctttccctcattctatttttccatatttccccaaattctgtaattagaatatatatattttatgatatgattattttaaaatgtatttatacaaaactgtaataaagatttatttcagaggtatgtctgaagtttgtaattctatacctaacaaatattaatgtttagtattaaagcatataaaattcactttatcaaagtaataaaatattcatcatggatacaatttctacaaaactgccaaaatgtacacctgaactaactccccaaatcactattgccactatgattaaaggctttaagtcatcatttaaaaatatgataggaatacttttatgaaaagaatattttctcatatataatagctataaatagaatgtaatatataatattaaatatattagaataggtattagaaatatgtctctaatttagtatatgtattagcactgtaaagctatagaatttggaaccccgccccccccacccagtgtcttgcaacatatcacacaagaaatttccttgaggagagaacacaagtaagtgcttttcaacatgcattctgtttaaagagccttccaatacagaaacaagtacactctccctcaccaaatttctcaactgacagacacagcagttgaaacagctggcctctaactgcctttactaaaaaaaatcaaatatcctctaagctaataacatccatgatatgtatatctaaaactctataaagtgtcaccatactgcttaaaaataagctttgtcaaaaaataaatgaaaaagtaatcagatacctctgtagaatggatcaaaatttttttaaactcaaacatgttaaaataatttaatcatgacatgagtctggaattattaaagtggtgctgatggacacacagaccatgaaaatgttagccctcattaatgagccactttataatacatggtttaaaaaaagagcagcaataagaatttgcaagtagttgctcaaaaagaaaatactgaattatacaaaactctttccaataaagcagaatttgtcatgacaaaacttatgaaataatttgtgaattacaaattaatttatagagttattgtatgctatttgacatgaagtcttagtcaattttcaatttactttgccagtcataagtttctctttgaagcatgtctatttcaagatacagaatcttatttggtcatgcaattatttgtccacttatccaacaaacatttacaagtatctgcaatattaattactgtgccaggcgcagactgaaagataaactaagaaatgtcaccaaatgcctgaaggccacaacatgtatgactgcaatacaaagggagaaatctggcaagctccataagatatgaaatatctattgaaaggacaaagaaggagacaacaatctctctggctagagaaagtaaggagaggtgggggaagaagttagagaccatggaggaggcaggacctgcactggatcttaaaggagagagtactgcaacagtaccaggtgtactcactccatcaggaagatggagcaggaactttctccctccctgtgaacagattgcttactcccttctctagcaggctcacctaatttattcaaaatacaacctcacacatcaatcttttcaggaaatctgtgagaccaacctccccaagcctgtttctgcatgctctcaaaagccctgtgcacgcgtctatcacagccctttcactaactctactaaatgccaggctgtcatccacactcataggccaggaaatacttgaggaaggaatgtctgtcttttacctctggatctctaaaacttatcaagttgcccagcaaagcgagtgctaaaagatctaatgatgagctgaataaacgaataaaaaatgtgcaactattatctaccaaacccatttaggaggctatctaaaagagttgaagcagccaggcacagtgagtagctcacgcctgtaatcccaggactttcagagcctgagatagggggattgccttacacccagaagttcaagaccaaccagcctgaggaacacagagagactctgtctttaaaaaaaataaaacaaacaactacttgggcatggtgccacatgactgtagttccagctactcaggaggctgaggcaggaggatcacttgagcccaggcattggaggctgcagtaagctaggttctcacaaatgcactagagcctgggtaacagagaaactgtgtctcaaaacacaaaacaaagagttgaagcaaaaagaaaagagagttcaaattgggatggtgaaaaggaagaaatgaaaaaggtgttgagatgggataagaaaaagaaaaaaatcaggcatgcttgaaagcttaggaaaattattgtgccattcacagagggggaaagttgatgagtctactgggaatatgctgagtttggggctgtattactaacaaataaccctcagcagaaattcaaattatccagaacattgcctcaaaaaaatgcaaaagtacttatttcctcaacaaaacatcaaattttaatttaaacactaatagcataatgtggcatatatcaactatccacaatttctttataaaacagaaaattttgataaattttcacttactatatttacatttaataagttacttttatataagttattcatgctttatttcaatgtgtatacattatcattaataaaattttggccaggtgcggcggctaacacctgtaatcccagcactttggaaggcctaagtgggtggatcacgaggtccggtgttcgagaccagcctgaccaacatggtgaaatcctgcctctactaaaaatgcaaaaattagccaggcgtggtggcacgcacctgtaatcccagctactcaggaggctgaggcaggagaatcacttgaacctgggaggccgaggttgcagtgagccgagatagcaccactgcactccagcttgggcgacagagcgagactctgtctcaaaataaataaataaataattttaaaaaaaattttatcagacataggaagaaaataatttcctgttactaaacaaattccaaataaattaagcattgcctatatttaagagggtaaaattatatactaatatatgagaagtaatgtattttattccatgagtttacacatataccacacaaaataaaataaaatacaatttacctagaaaatggctacatatatttattccatgaatgactggcccactgagatcagccagttaattaaaaaaccccagggtatgaagaaataaaaagaggtttctctcctaaaaaagttagggatggtgattagctctcggggagatacaaaggatagggatcaacaaaaagcacacaggtagcttcaaaagtagggagaatgttctagttattgagtggaggcttattgggtgcttattgttataaaattaaatatatatgatataattatatatatcaaattttatgcaataaaacttttaacattcctatgtaatcaatgtaactgaaggaaaacaggaaacctattgtaaaacaattaactgtatataaatattatatcacaatactttgtgtacctttatactacttgctgcacctaagttattttttcaacaaatatagaacttgacaattttatatttttctttaaattgccacatttttgtaagaatttgctacatacaacaatgttgttcaaaaggaaactacaaaacaacaaaaatttgtcttccattgttcactggttaaacaagatgaaccagaagagtagaacagctttctgagtaggtttctctgggcttcggttaagggctgagttttagtttgcagtgacaactgaatcatttagaagaagtaatcctagaaacttactgtatagtgagatatttttaatcagttaatgaattaagtttaccaaaatactgaactcctctttaaccattttcctaccattttataataacatttttcactatattgttgtccttccagaagacagcatggagggactgtctgaaacttcactttgatcttgttatagtagcatttaaaagactatcttctctcacaggttggaactctaaatgtattttcccaaagaaatactcaatcccccacactgcaatgggaagataaaatgtaaggcatagtgctttgtatgaaggactctgaagtttgtaagatcagttaagcacacacaggtaaatacagacagattaagataagtcctctctaatagcaatcaacaggaggtgacagtggaaagagtcagaatttacagtcagagaaaaccagattgaaatcctgactcttatcacttactaattttgaggccttatacaagagcctcagtattcttttttaaaatggacataatattgttctaggaggctgcagtgtggattaaataaaataaaacaaagtatcttgtaaatatatacttattgtctcatagaaggggctcttcaaataatggctattaatatttatatttttctaaattattattaatgatgaagatggcattattgattttggtagtaataaacatagttctaaggagttaaaatgagactgtaacaccagaaaaggggctcaggtaactaaaaaaatcagtgatgtcattgtgtcattgtgtgtaattacaatgatagctaagagatttaaaaacaaaaccaaacaaacttaacaaaaaagctgccctctctcctcttcaaacctaccaatttccctatgctagagtaagagaagttatggcagataaaaggtctatgatttctccttaagtattgctaaatctctcaactggaattagaggaattttgtcacttaagaaacagcctacgtcatttaaaataattttattctaaaaataactgtatactgataattacaacaaatttaccatatgaataacataacattttgttataatcagatatttaaactactttgagcaacttccccaaatcatttatttagactttttttttcggttgggtgggggcgggggtggtacttaagccccatctacattatagctttcaaaatttctttaaatcaatactatatgaaaggctttctttatctccctgggcagaaataatcttgtcctcctttaagagcccatagtactttattcatgcttgaattgtaatgccattcatgtcttctattatgtttatttaggtagatagcctttatttttcctaacactgtccactgaaatcatttaatatttattaaataaacacataaagacatgtgaatatgcttaatgatctataaagtgatttgaaatataaagatatgttttacagttaaaatattgctaatactccatttaatgcattgcagtgtagtttactagaaatactattgtaacttaaaatctttaacacagcctctatataatcattaattgccaatgatttattaaaacactgcatacattacaccctaataaatggggaagactgatgttaaaaaatataccaatccagccctagaaatactatgagtcaacctcagtataagcccaaggaagactttaaaaataaattaaaattctagttaacaaaaaagttagatgcccaagaaaagcccagtacatgtaagatttctagtaattcgtgattattaccattaaaaagatccataaaaggtgacatattgctaaattttaatttttatattcagtttattcaacatttcaatggaaatgagaagtattaatctaattgtctaaacaaagttctcacacaatcaggtagaggtttacactagttattaatatcacagtatggcacctgacaaccactttctttattttcttcatttaatgaaatacagaaaagaattctattatttcctggaagtgtggatatactttttttttttattatttgtgtctcctaactagttctgaagagcagtaatgctttcattcaatgaaagaagaaaatgaatgtttaatatcaagacctatagaagaatgtaaatacaactaaacgtaagtaaaggatacaaaataataaggatgacacatgccacttctgggtccataactgaagagttgtggagattctatgtacaaatataaaaatgatttactaatttttttcttaaaatgttgttcttgccaagaaaccttcaaattttaatttgtccaaattgttccaatttgccaaatcaataatgtataatcagaacttaatccatctacatagtctcagttctacttccaattcaagacaagtaaccatgaagttgagaaattacagtactttcttgactgcctggaagccaaaaataaaagaaaagtagcaagaattagtttttaacatcccttttacaacatcaaaaaaggttacttagggatacacacacacacacacacacacacacacacacacaaaacatttagattttatagatgaggcctaattttgcatacatggtcaagtagttttataaagtcctgattcatgtactactaatatcaccaatttaggaattaataaaactagtaaaatcaaagaatatcaaaatgacttaactgattaagcctgaagttttacagaaatataaaatgaaatcccttttaactttagcaatggagtagaggtaaaatacagttgtaataacttattttttaaccctatactataatgtattatattttacaaaaacagtgactgtgacacatcagaatctatgtaatagtcaaatggtttctaacgatcaagaaatacactgggagatgaatgtcaagaagccattacttccacataaaatattttaccaccacgaggctttgaaatgcaaaataaatcacaggtactatttctaaattatctgccatcagaaccatcagtccactggattctgaactgcagtcacagctcttcttggactttatataatttgacaacagtgtacagttctaaacatgtataaataaacagaatatcaaagcagcagaaaaaaattggcttttgttaagtactaatctaactgtgcttgggattaaaatggcgtaatttctaattctcatgaaaatataaggcaaaaattctattatcactattcaacatttactaagcatgccctcaatgcccatctaacaaaaactttttagaagatagaaattacatataaaatataagatgcttgagatgcttccatactacttattttcaaaataagccaaattatatatgagtgtacccatctacatgctcagtataatgaatgttctatgcacgcacatgctaacacaaaaggtaagaaattcttcaattgactcagagttccccaaatatggtatgtatgactaacagctgagaggaaatacaactgaaactgtctgctggaaatccattaaaatctaggcacagaaaaatgcctggttgatagtatagttggatgtgcaaatttatgcaggaatgtagccaaatctttggcaattccctcatggtcttagatttattaacaatagccctttctttttcagctgtaatgttacatttaaagaacattagtggagttggaggacctgcctggtctttaaaacaaatagactaaaggcttgggtatacagagtcatggaatttcaaatacaaacaaaaatttgcacaaaaaaagtatgctccacaaaagcttccatatgcaactctcaaaaatcagtaccttagaaaaaacaagcatactattttgcaattctttctacatttgcctttgaacgtattcattattttaaaaatttttctgcaaaaatgatttgtatcatcttctctgaaatgagtgttattaaaagacttcataggttaagacatatcctcttaatatactacttcacggatttattttcagtatttgcttgttgttaggagtaaattaagtacttaactcttacaagtcatttaacaaccacatttgattcttgttactctgtactgagccccttctatgctctcaattctgtggaatgttgtatcaaaaaatgaaagcatggtattttcttcttcaagagtttataattcaatatgagtacaagttaaacaaacgtattcattcaaaggcacaaatattctacaaccagttctgattagtgtgacaatataaaataaaattgttgaccattttgaaggaaaagttctgtaatttttcaggagaacaataataagaggtaaaattgacacaatactttgcagtttaagaaatgattctcattgaattccctgaatcctcagaacaccccatgagactccatgagtatgatttcccattttactgatgaagaacctgatatccagaaaaggaaagagactaaacgaaatttatgcctaagtagtagagcaaagattcaaacgtagttctcacagctaaatcaaggctgccactggatttataagttctttcataaaagtaatctaatttgatcattatgacaattttattagataataatagcagataatattcattgactgcatatagtggggcaggtgctgttctatgctatgttaattcattcattccacacaaaaccctatgaggaagggttctgttattactgctattttacagatgaagaaactgaggctcagagaaactagttaatgtgctcaagatcacacagccagtaggtatgggcagcagaagttaaactcaagagcttctggttgcagcgttaataatgttcttcaccaccagctcactcttaggtacgttaacctacaacaggttaagaaacttgcccaaagtcacaaggaaaaaaaattgcagaaaacgggcaagaagaatgtctcctaactcttcaccctagttcctttttctaagtagaataatgaaaatcattacatccagaagcggtaaaaagctttgggacatgtaggtagttctttgaagcagaatatgagcaagtaaggaaacactggtggagtagcaaggagaaaagattccatcaggccaaagaaggcttcttctccacagattgaagggaaaagagagtaaaatgtatgtgaccagggataagtacatttgttattctgatttagggaggacaaattcagatgagtgaagagggatggctctaattaagaaagttagtaaaagtgaagcactacactgatttgttttgaaagaaacaccaccaaaaatcttggaataggtattgtaatgctttcaaaagaaatgatacccccaccacagccaaaagtatctagcacacagaagaaaataagagaagcactgaaagattctaactacacattttcatttttttaaattaaaatgtcacttatagtttagcaattccttttcattgttaaaacctttctgtggagtagagactaagagaacataattaacataatattcttctcattagttttcataccatgattctatggtgctggttactttatagatctttctcagaatcatgtcaaaatcagatgaaggaaattaaaacaacaacccatgtgaatggataaactaaaataccaacctaaacctaaaatgcatgttaaaagtagaatttgcaataaatatggaaaaactaatcatggcagagaccgaaagcaatgatgccaggattttggtaagaagcacttttgaaaagacatattaaatgaggaaaactaaacctaatggaatttcttctctcattacttaaaataaaccaggtcactgagatgagcgtacactatggtattttgttcattttcatttcatttttataccataaattcccatggaaatacctcagacacgtgcccacaataattggaatgcctaacatttcagcgtaagtacttttgcatgagttctactaaataaaaagaatgcagtgagagccctccaagttttttggttatgtcaacagctattttacgagtatgaattatctctgtacctataaactacatgtgtaaaatacattacatgagtctgtgtgaagccttaatgcgaagaccaaggtctgagctgcacacagaaacatcaaaataaaactaaacttcctagaatatagcaatcataaattttcttaccaaagctattactgttaaatataccttgatgaattaagttcaagtgtaactacaattgaaatgtatgattcaactgagctatgacctacttccctctcaaaagcaaaagggaattatgacagttgtgagacttatatttttccattccatggtctaaaagttgttttatacttaaactataagcaaaatgcacctgacatttatttgctttaaaatatagttattcatgctattgctcataggacagatagaattttaatagcaatgtatcaaataataattatatctttccatgtatttttaagctgtacagaccaagaagcattcaggaagaaaataatcttaatatataatatgatacctaagtctaaagttcagttataactacatgatatatttacatacaacagaacctataatcaacatgacaaatacaaaattaaccaatatatgtggttgaaaatacccacccctagcagaaagctttttggtgttgataattttggcagcatattcttgtccagtaggaattttcatacatcttctcaccactgagaatgcccccctggaaaccaataattagcaggtcattaatataacagatataatatttcattaaaaatttataaaatctgagcatttttattgattttagtggattgccagtgaagtacagtaatatccagtaaatgaacaattcttcctggaaacccagactttctttaatgttgaagaataaaagtaaattttatttaactgggagcacacattattaatcaacaaaatgaaaggaactgccaattatgaccgctcttgtttgcacaagaaatttgaaaacattttacagttcacactcacagcaccaaatgctctgagaaaaaccctgcacagaacagagcagacgaggagcagcaaaaaaatctgctgcctacttattttggtaggaaacaaaaaattaatgtggttccaagtaagtaaacatgacgattattttcattaaaatataaatcttgagcacattagtgtggtttaacaaatcctggtatggtgatttctctatgccttgttttggactgggggaggggagagatttgaattaagctgctcttccgacatattctccatgttttaacaccagacaatatatacatatgtaatttttattacttttaaaaatatttacctttcctttaattacagtataaaccaacaacatacatataaacgcactcctttcataaaagtaacagtcgaaactagtgaaagaggaattgggtttgggttccatgctacaaaaatcagcattcacggcttggcccctaggtccctttgcataagtcctcagtaggtctcctgcctccttccctaacatctccaagtagttctgccagtcgggtgaaggaggtggttttacacaatgctaggctacgcttaagagcgctctcagtctccagagggcttttccgttgcctgtataaataaatcctcccagagaacgcaaagatgcacacgtaaatcctaggaagaatgatggtgagcggtaatctggtgcaaagaacaacactggatatagggcaaggggttgggttctgttgggtggcccttttcctggacagaacaactactggatgcgaaatagactctatgccaagttgaactttcggcatcaataaatatggcaccgtctgaggctgtgagttctcatcagtacctgggtcatacggccgacacgccggctaaccaggaggcatctctatttacagaaaacatgatctatgttgcattttacatgggttctaatttcctctccaaacacacattacacacaggcgcgcgcgcacacttctcaggatgatagctacaactgcagagatcgtaaattcactaagtctctcagtgcaggagggtgggggaccgggagaaggtgggctagggaccatcaaaatgagccacagttggagtaagggtcctaccccttctgtgctccctccctttattaagacagcaccttccccagagctgacaaaccaggggccctcctcccattcctctcccaaactccctcgccccaagacggaggccggtgggtcgggggcaacgcgacccgccctcagctggaaaggggatatgcggatgccgggcaaaggtgcttactttccaagctcctcgaaaagctgatactcgtccgtgaacctggtgcaggttgtggtcgaagccatcctcggtccgggctgtgccctggctgggagcgcgacggaccagaagcgagcagacgcgcggctaaccccgggactggccccgcggcgctgtcacccagggccgctcttactttcctggtccgaaagtagctcgcccgcgagggagtgtgcgcaggggcggggcgggaggggagatgaccagaaagggtggcgtggggtctcctccccacagtccgccgatcctcctcctcctgcgggcctcgcttccttcttctccactggacgctccacccgccccttttccagtccctgtccccaaatgcagggggtaaagtactcaagaagagggggccgggaaatggaaaaacagccaggcacgggacgagtggcaagcagttgcgaaacgatccgcactggagcaggaggagtagaagcagaggggagggagtccgagggggcggaggtggagtgcagcggggccgaggccgcggagcccagagcggacagcctgagcccagcggccgctgtcagcaggctcaggcgcggggcgcgccggggctccgacgagcgtgcgcgcccgaggccggcttccctccggcgggcggcagcggctccggcgaagcgaggcaccttggcggcctcgcgctgctcacgagcccgcgcggcttcaagacggcgcggcgagagaaagagcgctcggctcaggcgaagcctcttctgccgtccccaggcctccgtctcctcctccggcgcctcctcccgccgctccctccgcctgccagcaccccctccctggcgaagccccctcctcgctggtcccacacctccctctagcgactccaagcctgtcccttcgtggatctctcgcactccctcctttggttgcacacacgagcacaccagtctagggagaaaccaggtgggtggaggaggatgtgcgggggagaagactggaggtttgggtgaatgaggcgagaagtcacagttacccatttaaacccgcacagagaaggctgcctcaatctggggctgactgagcgggaagatgcagggcaactcgaggatggcccggggcagccgccctgggtcgcggaagcccacgcccctgttttgggcgccgggcagcagggacttctccaggccggttcccgggccacgacacccggtgggccgagcaagggagagcaaccacttcatctccacgccgctcagagttgacacagcaggggccggatgtgggctgttcactgctctcagagaagggtcccaacccttcccacagccaccagcgactgtcggggcaaaacccagcctcagcagggttcactgcgtcgccagctccccagaaccgggcgcaggttttctccctcccccgcagccccttctgcaaggggcaatgacggcccctgagccacattacacttgccacctccaggcccacctcccccgctgttttccaggatggtggctgagactctggcaatccccaaaggcctttgctttggctgtgaacgttaaaagaatgaaagcaaaaactccgccgcacaaccacaccttcccttcccttctgagtaactcccctgcaacctcagtaagttctgatagtaaggcgaattctcgcgatatttcccactctggcggtcagggggaggtagtaggaaggctgggtgtcggtcacgcgacccggcgggggctgacgtcattcacatcacgtgaacacgtctagactgtttcgctttgcaaagggaaaaaagaaaaggggccgtcgtgtgtgcttttgctttcagccagatagtggcaattgagtgcactccgtaaatggctatctggaaaaaccatttagcagttcaagaatgtgtccttccctttagcatatctgccattgttttcagtaggaggaaaaaaaaagtatgcattacgatttaaaatagataaactgctgccgattgctagaacaacttctgggccctctttccagttctccttaatgaaactatgcaattgcaaatttagccgcagaccaaaaacagcgttatggacggtctttttcaaattactgccaattgttctacagcacgggactataaaaaccttgcaatcctattgctaatttgctcgtggtattacttcatagacaaaatttcacagctgaaagataaaagataatttgcagacacaagagaatctaagatttaaaggcgctgctgcttgctcccaaagactgctattaattaatgttactttgtggtcatagataatcctaattccttttttcctgatctggggaacgcttctgccaatgagtgagctttttactgaagtactaaaaatgttcacaaattttaacgtttattacaacaaaattgaagttcgtatgtgttttgattcccagccgtaaaaggcaagaaataactgtgtaaaatgtagtgctatagaaaaagatgataccaagaactgcataaaagaaacatggtctctaaatattaataattgggctataaattgaaaaaaaaaacacaatttggtcttggctaaagatttgtaatatctgaactatttagcaatgtggctccaaggtgataatgaaataatttaatatttttccctgaatctaagaatgaaacagaaaaagtaaaattaaaacaataaaggtaatataaaaatttacatctgggaagaaaattgtttcttaaatattcaagtaatgaagtctacataattacagtatttatctcagttatttaaactaccaataattgtaaatggttataattgtggagtacaataaaggaaacataactgagttttaatactgatgtattattagacaataaatgtgtacattttttacagcaaacactgcttaatctgtacgtaccctttctttgatttatattttagactaaatatttctcttatttgaacaaatatttacagttatttctgaagtttgaacctccttaaaaagtagtcagattagccgggcgcagtggctcacgcctgtaatctcagcactttgggaggccgaggcgggtggatcatctgaggtcaggggttcgaaaccatcctggccaacatggcaaaaccccgtctctaataaaaatacaagattagtcgggcatggtggcatatgcttgtaatcccagccactttggagggtgaggcaggagaatcgcttgaacctgggagaaggagggaggttgcagtgacccgaattcgcgccactgcactccagcctgggcaacaagagcaaaactctgtctgaaaaaaaaaaaatagtcagatcaaagactttgttgttgttgttctacttcaacatcatttcaggaatagctacaaaatagagataaattctaaaaagtgtagaaatgtagacctataaacataataacactggatgttagtgccaaatgtatttacatttcattatacatgccttactaactgcatgtctgatgaacatggtagagaaagttaagagggagagttagtgaataaaaagttagtcattaaagttgttgaagataataaggcaggctttattcaagggggtccatggtgatcagaaccactgcaaccaggtcttgcaggaggagagagagattggactctatttcaactcttaaaaggccaagtggggatttacaagcaaggagcagggtagagggctgtggatataaaatgactaagtattctccctctttcctctttggcaacttggaatttaaaaaaatccaagacttcagtagtttcacccagaaagtacaagtttctaatgcttacattaacaaaggcagatattaacagatactaacattcattgatttcctctgctacaaagttataagataagaaacagcgaagagataatgttatctctatagctccccaaagtgcagagtccatcagtaaatagcagattcctgtgaaaattttagcaggtgctgtgttgaagccactcttcactgcagatttggaggctaggggaaaaaagtaacagcaagttgctgcctttccaaactatgataactaaaccatatagagccagacagtctactgatgagcagataatctgtttaccagaccatccattagtgcaagatgaatttgcagttaaaaaacaaactattcataaaagcaaagctaacaacagaagatattttctttgtttcatcatgtgctgaaagaatctttttcctaaaaataaaaataaatgtgcaaataaataagaaaacaagtgatatccatacaatgaagaaatgtctcttttgcattacttgcaagtacattggtcagcatgcttgaccctccatgaacatacatgtttccctgacactctgctaaaagaattgcagtaggaaggtacattaaataagatgtataatacacaataattgtataaaaggttatagagtcattaataaagaaaataacagattttgactcttctgtgtacctctaatgattttcattgactttcaactttgcaaacacttattacactggactgtaattagactgtcagacccttcctggcagggactgtcattcagtccccccactgtatcactagcacagggtttttgccacaacaggtgctcaaaaataccttttttttaaaaaaaaaaaaaaacaatattatggtattaacagtcttgactttccaaatattaaaaatgcccaatctttaatagggtataatgaggcccctttgttgcaatatttagttgattctttgtaatcctgaagtaacttgacttctctgtataatttcatactcttgacctgaaattctctctgttggttttcatgtctgataccacactttctattcacaatacctcacccattccacaacatttctgcctcttttcttcagtatcattcctggtctcttttttctctgcctctgtggtaagtgatagtgctttcaacctaggattccatcttaggttgcctttttttctcattttacacagctttcctaggctgccttcatagctatcactgtgttaattatcatatgtcttaaatttgactctccagatgtagaccctaagacaagaatgtatggaaaagggatttattgaggtagtatttccagggacaaggataatgttaaagaaaaaaatctcattcaatgatacttgctgaagtatagtaagacagattttattcagactatcacagtaggtatagttaccactgcaagggggttttgcagtaggggaaagagattgggctgaacttcaaatgcaaaaaaaaaaaaaaaggaaaagtgggaatttatatctaaggagtgggagtggaggaaggtagatgaatggaaaattactaaaaggaaacttctgaggtaaggggatagtctggctaaacctacctaacaagattcttactgaaggcaggctggaagattctggataaacaaacttagcaggattcttaataaaattgggctgatgcaaacatttgacatggaaattcaaacgtcgagggtaggaaagaggattgagagaagcctaactaaaatttggtgaaggagagactctttgtcagtagagaattggagaacatgggacaaaaacaatgcaaaaacaaaaagcagcatgtgccttcaagtaaagtcccagcatcagccttattttcagggagctctggagtatatgttatacccagttttgttaccctcaaagcaagggctttcctatttcttcaccagtcattcattgatcactagcaatggaagagggaaacaaacggacataaactcccttggggtcagggtctggccgtccttcctggcgggttgaacagctccagtggctccagagtatgccactgaggaaaaagtcacaggtagaggctattacaagaaaagactgcagaagtggggtatgcacacagaactagggcatgggcacagaactgggattccagagaacggagagtggaagcaccaacagaatcagctggatactaaagtgctaatgaccctgcaatctctgtctgtagcaaaggtctttttctgagcttcagactcatattgcccgctccctacaggaaacttcctcctggacattgcacctctgactcaacatgtctaaaattaatatgtcttccttctacatctgcacctcctccatatctcagtgaaatttcagggtcatcccacaatcaatcacaagtccatatacatcataacattcctactgcaaatgccttagtttaggccaccatcgtttctcacttggattcagaggaattcatactaaacaaatctatcatgtctcttctcagtatagatatcattattagctccccatatatctttaggaaaaaagttcaaaaagtctttagtacaccctaccaggcatttcaaactactcactgcttagtttcatactcattccttgtacccacacataccctaactcctaaacatttctagaattatcttgcatttctcattaccagcattctagatcaaactattgtcttctctaaccagtttgcggaaacaacctcttaactgcattaataattgtgctttcttccctctcctacacacagctgagagaaacatcttttgaaaataaatttgatcccatcattcctttgctaaaatgtttcaggtatgcctccagtgatcttgaaataaagaccaaaatctatcaaggtttaaaaagccttacatgatcctccaatattgttatacttactatgattagtattttaacctgtctgaaaatttttgaatggtttgaggcaggcaggtatctactttcattttcttttcccctcaaatggatagctagttttgccaatgcattaactgaatagtccatctgtccatctttatcctttcccacttgtttgaaagacctttttttttttttttttttttggagacggggtctcactctgcttcctaggcgctggagtgcagtggtgcgatctcagctcactgcaacctccacctcctggattcaagcaattctcgtgcctcagtctcctgagtagctggaactacaggcatgcaccactatgtccaactttttgtatttcagtagagacaggctttcaccatgttgcccaggccggtctcaaactcctgagctcaggcaatctttggcctcccaaagtgcacggattacaggcgtgagctactgtgcctggcctgaaagacctttaaaaaaaatcatatattcatttacattggattatttcattactcttcattacgttcagtttatcactttgtcaattcctttaacagtactcttctcttgattcatgtagctttagaggagggtagcatttatctcaacaatcttggtgtttaaaagttaacttttcctaaaagccaatggcttagcctttaaattaccttggtcaaaagtcgaaaattattttttcatcatgtaggggccaataccaaggattcactacatgctatgtagcgggtagctaatacaaactataatcaaaatagactttagaatatatttttaatctattatcaccaaacctacagaattatagtactctgtctcatttacgtaatgagatgtccagccaatttattattattattattattgagatggagtctcactctctcctggagtgcaatggcacgatcttggctcactacaacctccaagtcccaggttcaagcgattcttctgcctcagcctcccgagtagctgggattacaggcgcccaccactaccctcggctacattttgtatttttagtagagatggggtttcaccacgttggccaggctggtcttgaactcctgacatcaggtgattcgccagcctcgagcctcccaaagtgctgggattacaggcgtgagccacctcgaccagtgctaatttattattattcaggtgctacttattcatttcctacatagtcaagggccctgttatttcttattctcctgcttttttgtttcctagagttggcttagacttgttgattcattccttcaaaaagcagaaagaagttttaaaaatctgtttgcctaatgacttaacacatgtggctaaacctaaccaccaaggtctgttccatcttactacacaaacaaggtttgggctgaatacatagctagaataccagattttcctgttttgagattaattttttggcaaagaaatggagcaaaagtgatatatgccgcttccagacctggttcatgttctggaatgttctctaatgttcttcagtctctgaacgactgggatggcaattcctagggcaatcttataagtatcatattgaagattgcagaaccactgtcagcctggggccctgaaagacttcatacaacagagctgctgctaatatggaacccttgccctgaccaaagaaataaacttcctgttctttaaggaaccgaattttgaggattctatttgtttctgtaatttatcctcccctatctaaaacaaagtatggaaacaaatttttaaaatcaaaagcgctatacaaatatttattgtaatttaaaccttaagaataaaattacgattaaatgaaaatatgtgatttgcattaaggccatattttatttttgtctattgtgcctgtgtccatgagtgtggtaattgagagttagctgtgttgtagaatggcccaactccaaccagaacaagtatctttatagttaaataattaaaaaaaaaaacactacattcttgttcctattttccccgccttcttcccccacttcccccacacatgatttccattcaatgaggaaaacagatttttaaaggttctgaaagttatgacaataccactgaaaaaggtgatgcatctttatccttaaagctctcccatttttaatgtttttctgtttcatttatcagtggttaaaaaaaaaaaagagcctcaattagtaactcgtatgtgaacaacacctctttttcacaactgcttggtttgtttaacaaggaaaaagtgctatcaacttaagagtgaaaaggtgtttttgaaggtagaggtaattatggtgggttgtcaaacaacatagtaatagaaaacaaaatgaaggacccctacagcttaaatatgaagactgttgtaattaattttgcaacatttattctataagttggtgtgtgtgtgtgtgtgtgtgtgtgtgtgtgttagaccaggtgctctgagaatataatgtggaaaaaatagtgtctccacttttatagggtttatttttcagtgggacaaataggcattaaaccaattactcattaaaaaattaagtaatataaaggaagaatacggagaatgtgtattatttgtcttggtggagtaggcacaggtttttctgagaatgtatgagcaaaatgagatccaaaggatcctattattttgtttataatagttaaatagttaatattaataactaaattaaagagaaagtacagggaaaagcattctagtagatgaaacaggacaaattcaaggaaccaagtgggtctgatgtggtaagagtgtagtaagggaaatgattctatagaattgggcagaagagtgtctcatggggcacttaaaattaggcgaagaactgtgcaaacactgaaaggatttaagaatgggtgtgacatgtctatatgatagagttcattatcactatctggtggaaaatgaattttccctatcagcagtgactttaaaaggcaaggtaaggaaaagtgatagctagactttaggtggtggtagtaaaaatataaatcaatgaatatttaaaatatatttggaaaataaatagtaaaaaattttttaaaattgacaattgataacttctgtgttaatataaattagataaaactgtagagcacttatgttggtatgactggggtctttttgtttttaaattctgctcaggaaatataaaaccacaaatcaatgaattactgtttgcttcaggcaattccatcagaccaagttattagagagaggaccctgtcacctggtcaagtagcttgcttaacagtttagttataaagacttactttactgtttccaccaattttaaactagtagatcatgaactttgcccaattctcaatcaatgcccctttgagaaagactttattaagccacttgaggccagactttaaatgctataaatatctcacctctagtttccttctaaagcactaggattctaacaagacggtatcctatttgcagcactttattaacagattgtttaaagatattttggggagttaatgtaaacataggaagttcagaaacactgggatagtcataccataaaatatataaagctattattgcattgaattatgctgtagggaagtattgtgatagaaaagtgtcacaatatattaataaaattaaagttattgaaaagtttacatattttaacctcagttttgtgtttggttgtttacatggatagatgatggatagatattcagttctctaagtaaaactatttttaattatgattacctcctatggaggtggaaataagaataatttt

SEQ ID NO: 247 - DNA, 576316 bp, Homo sapiens
ctgtgccacacaccttttgaggctagaaggcttggccccatgtcttctgaagctggaagccttggccccacatctgtttcttttttgcaatcatctcatttattcaggtgtcatggtggctactgaatctttgccccactttccattcacagagaaacgcctctctcactgacgacttggaccaatttatgggaatactgcacacattgcttacatttttctctgcctgcagcctcttgtctcttctaatccaggggtccccaacccccgggctgaggacctgtactggtgtgtggcctgttaggaatgggacctcacaacaggagatgagccgccttggagcaagcattaccacctgagctccaccctgtcagatcagggtggcattcgattctcacaggagtgtgaaccctattgtgaactgtgcatgcgagagatctaagttgcatgctctttatgagtctaatgcctgatgatccgaagtggaaccattttatcctgaaaccatccccactgtgtcctaccccctgcccctaccctgttcgtggaaaaattgtcttccatgaaactggtccctggtgccaaaaaaggttggggaccgctgctctaatccaccccatctccgctgggtgcggtggcttatgtgtgtaatcccagcactttgggaggctgaggtgggcagatcacctgaggtcaggagttcaagaccagcctggccaacatggtgaaaccctgtttctactaaaaaatacaaaaactagccaggcgtggtggcaggtgcctgtaatctcagctactcaggaggctgaggaagggagaattgtttgagcccgggaggcggaggttgcagtgagccgagatcgtgccactgcactccagtctgggcaacagagtaagactccatctaaaaaaaaaaaaaaaaaaaaaaaattccatcccatttcatgctgtagctggacacatgcttatacagcaatttctgatgatgttattcccctgttcaaatgactctaattgctcccctcttgcttataaaataacctccaaacttttcctgcatggagacaatgcattctagtgaaaagagcaaaagtgagtgaatcagagacacaagggttccaactgctgcttttgccagatgttagatatgtggccttggacaaatttccaaacttctctttgcttcagcttccccaaatagaaataagacttataaacttattgagaattgtcataaaattaaaacagccttcatttattgaaagtttattgcatgttagactttttaaaatgcaacacctcatttaatcttcataaccatgttctactattcctctattttctttttttttcttttctttctttttttctttttttttcttttttgagacagaatctctctctgtcacccaggctggagtgaagtggcgcgatcttggctcaccacaacctccgcctccggggttcaagtgattctcacgcctcaacctcctgagtagctgagactacaggcatgcaccaccacacctggctaatttttgtatttttagtacagatggggttttgccatgttggccagtctggtcttgaactcctggcctcaagtgacccgcccaccttagcctcccaaagtgctgagattacaggcgtgagtcactgcacctggccttattcctctattttttaggatcaggaaactcggactcagagaagctaagcacccagcccaattccagatccttaactgacctgtgctgaggccttgcctagtactgcaggtagacagtacatgtagttccctttgtcttccataatctgactctgacacaccttcaaaagcttatctcatgctagttttctcccagcagttgtcatctccatggtctgaactacctgaccggctgcgactccacctacaaggcccttccctgcatttctacctattgaagtcctactgctatcctaaactctagctaagtgtcacctcttcctagaagacctgattgcaaatgttcctgcctccctggaaatctcataatacttgccatttctcttacgcaaagatcatgttttctcttatattatcattttttcccttttgtgcatatgttttattttccttcttgaatcacaaactctttctgggcaaggagcatgttgccaaagtcttattcaaccttgtttgccttttaattccaggctcagtccctgggacagatgaggcacttgcaaaattctgtagaatatttaatttttgcacaaatttaatccagctttgaagcgttgagctcaatctacagtctgcatgaagtgaatgtgttcctcacgtgttagaggtgatatcacagggagaacagtaattacaatgtgagatggagatggggccaattagtctttcttctttgccaataaaaaggcagagagagtgaacattatatggttttaggcaaagtacctgacagcagggaccagcggtaggaggtctacttaggtttgctatcttaattagcctatttaaaaaagatttctggcactataaagatgtgcggatttgcctttgaaggtatatggatttaccatcactctcgcgtgcacgcacacacaccctcccacacacaccccacaatccaaataagacagtagaaagggttttaaaagaaaactcttaatctaccccatttctatttcagcagcttccaaattcacatgcccgaatgcaataaataaaaatactggagaagaaaatcagataatacaagtgggaactcagtcagagaaaggttctctaacattgtaggaaatatcactctaggcagaaaactgctaccagatccttaactctgagaaagaacaggtggagacatgatgagtcaacgccgctgaggcttcacgcagcagccaccgtggcccggcttgggtaaatatttttattacaaacacagtgatgcgtaatgggccaaacgatcagtcctgacaaagattgcccacaggactgtgacactgcagtagctgggaaagtgggctagaacccgagcttacacgaacctgacgagcagcatcagggttgatgtcaggttagtgacagctgccgtcacctcacaggaagcaaaactgggaaatgcaaaattcagttttgagaaatctcagtcgatggcaagacgtttctttaaaaactgcaagattcgcaggaccctccacgatcctcttaggcaaatatttcttcttaaggaaacagtgtcttttctatttttctttctccctcaaactctcacaggctctgcttcttggactgagctgaattcagtcaaaccaaccgtttagatgtcttctttcttccttccttccttccttttcttttcttccttccttctttctttctttctctctctccttccttccttccctcggtccctccctccctctctccctttctttctttcttttttagagatggagtctcaccctctcacccagactggagtgcagtggcgcgacctcggctcactgcaacctcaacctcccgggttcaagcgattctcctgcctcagcttccaaagtagctgggattacaggcatgcgccactacgcccagctactttttgtattttttaagtagagacagggtttcacaatatgttggccaggctggtcccgaactcctgactgcaggtgatccgccggccttggccttccaaagtgctggattacaggtgcaagccaccttgcccagcctgtttagctattttcaaaacacctgcggatcacagggttagaccaattgtctggtgactgtggcattcagtaagatgtggagagttaagagagcagaggggccgcccagcccctgcacctggctccctttacacagttaccttctcccccgacccccaggctcaggctgagaagaatgagatccaggagatgggctaagaggccaggagagagagaactgggctgtggtggtgagaaagtgagaaagctaacggggcaattagaaggctgattcatttgtttatctagatgattatgctctacttagttgaatagttttgaagtgctctgtggttcaggaaatttcctctcaaaggcttatcaggtccacagccttccatgtgcctgacagttccacgaaagaaggctcctgagcacagggtatgggttttgagggaccttttaataatacgcttgctaatataattaagtcaagtaatgcataccaaacctcaagccgaggagaggtgaaaaaaaattcaactaaggttacttccatcttttaaaagaacagagaaaaaagacatggcctcttaaatatccctaactcagggtttcccaagaagtgtttctaaatccccaactggacctgtgattctagaaatgcaacatagattaacagaatttttgaacaggaaggaacttttaagcaatatcttaggtttgggcttctctgatcaatatttcacagaactctacaataaaatatgtgagtcacagaagaagctgaaagataattccatggatcaaatcattttaggaaattgcagattaaagaaaggtaggccgggcgcagtggcttatgcctgtaattccagcactttgggaggctgaggcaggcggatcacctgaggtcaggagtttgagacctgcctgaccaacatggtgaaaccccgcctctacttaaaatacaaaattagccgggcatggtggcacatgcctgtaatcccagctactcgggaggctgaggcaggagaatcacttgaacccgggtggtgggggttgcagtgagccgagatcaccccattgcactccagcctgggcgacaagagcgaaactctgtcttaaaaaaaaaaaaaaagaaaagaaaagaaaaaagaaagataaattggtttctttagcaaagggtgtggcagcttacagacggcaacagattctttgcctttgctgggtctgcgtcctccgcccttgtctctgggtaggttctgtctttgacagttgaagtgatcctgccagtttctgggcactggccttatggggttggtagcttcaatgtctggtctctggctgggcttgcactggagggcacctcaaagctgccattccccagcagatgggcagcatcagttgcccaccatgtgaatgggtcttgtgggcttgagcccttgcctcccatgactgccacaccagccaacacctgactgcacctgcctgaaacccaagtgagaacagcctagctgagcccgatgaaccctcagcactgagcgagatgacaggaagttactgtttaagccattaagttttggggtggttcatgttgctgtatggcacacagctggcaatcagcaactatttatttaatgaatgaatgactgagtgagtgactgagtaaatgtgaatcttccagagggtgatatagcacgtcacatttcctaaatatgacacctgaacacttcaagacaaattttgcagaacagggcttgacggaatgctagtctgagaaacaataaatgagaaggttgaaatggtagagtttgggaaatattggtcgagttatgcccttttatgttatagattagaaaagtgagccagacaggtcaagagaattgcccaaggaaacaaaactaattgttagactccacctgtgaacgaatctcctttcctagctaaagtaaagggtatggatacaatggtctccctcccatagccacattttagctaattaaatagatcaggcttctaacttggtagccctctctttctgttccatgataaagtctttgtgtccaactagccattttccatgagacctcttttacgtggcagacttccaaagatgatataagagtatgaattaggctaggtgcagtggctcacacctgtaatcccagcactttgggaggccaaggcgggcagaccacttgaggccatgagtttgagaccagcctggccaacatggtaaaaccccatctctactaaaaataaaaaaaattagctgggcatggcggtgcacacctgtaatcccagctacttgggaggctgaggcagaagaatcgcttgaacccacaaggcggaggttgcagtgagctgagatcgcaccactgcactctagcctgggcaacagagcaacagagcaagactgtctccaaaaaataaaaaaaaataaaaaaatatatgtattagcctaaagtctagattaagcgttctcaaaatagcagcacccatagcaacatcttggttctttggttcttttggttttcggtccagttcatttgcctggactgggtgcggtggctcatgcctgtaatcccagcactttgagaggccgaggtgggtggatcaccagaggtcgggagttccagaccagcctgaccaacatggagaaaccctgtcactactaaaaatacaaaattagctgggcatggtggtccatccctgtagtcccagctactcgggaggctgaggcaggagaatcgcttgaacccggaggtggaggttgcagtgagccgagatcgtgccattgcactccagcctgcgcaacaagagtgaaattccgtcttaaaaacaaagaaacaaaacaaaacaaaacaaacatttgtctgacggaaatcctcgcttaaaatgtaaatgtctggaagaacagattttcagtggaattagctatcagtgaggaatccagattttaaaatttcttcagtcttatgttacaaatttaatttctcttcctccatatgagaagtaaatcacatgatctgattttaaaacaatatagtgaagaatgttaacactagccagctcaaaatctagggtattccattttacttttctttctttttttagacagtcttgctctgttgcccaggctggagtgcaatggcgccatctcagctcactgcaacctccacctcccaggttcaagcgattctcctgtgtcagcctcccaagcagctgggattacaggtgcacgccaccaggccagctaaatatttttttgtatttttactagagacaggatttcaccatgttggccaggatagtctcaatctactgaccttgtgatctgcccacctcagcctcccagagtgctgggattacaagcatgagccactgcgcctggcctccatttccacatttcaaataccattacagcctatgccactgcttcctaatcaagtctccaaagccaagaaccacttcaatatcagttgaaagaaagttttatctaattatcttcattccccactttgaattgaccaaccatgtatctttttctggttttatcaaaggggctgccaggacaaaagcacatccaattttaagtaggctttagttagcagacttaaaattgatcatgtattttagtttcagtaacttgcaattcctacaccctttgataattcactttaaagagcaaaccgtctttaatgacaaggcttaaaagagacgacctttctgaacaaaatatgaaagctcagaagagatagttcttttaaggaaactatgaattaaaatgaccttgtgttctgaaacttttctcccaccatttttgatgttttacctttcctttttactcttagaaagcaagctaagacaccactgccttctatggatggtgatgcacttcaataagagggctgttaattgttaattccaactcacagtttcttctgtctgcactgtctctgcagatgcctttaatgaggttgctcaccactgtaagcatacacctgtttctgaagaaatcactgttgatatgtgacatcacaggataatgtttgaatctgagctatttccctttaatcacagtcaattcttttgtacggtctaggaagcaagtccgtcattctctgttccctcagtcttcctgttttcttcattatgccccgatggctgccttctgtgaagttcattgttgagtggggaggttgcaaaatcagagctcagacccctgaaagggcgcactgcttggtgatgcagaaatggtggactcgaacaaaattgtgacatacgtggatgactgaatagctaactttgctgttagcccttctcttccctgaccccgtaagtggataataacaaacaccaagaacctggggttgcagagtgtttcttctgcttggcttgttccaaaccctttaccagccactacctgttgacaattacgtgttgaaatagaaaaagcacaggtggatgactcaggtacagcagccaataatgataacttgagatgtaacaaaattaggtacttgtgatgaacaattgatcttccagcagataaaagaacagatggaatcttagatgattttataataaggcacagtgtttataatttatttcctgagctctttctttttctcccagtagccatttctatactcaccgctcaactcggtaaggaatttcaaacatgccaaatgcaatttttctttctcttcctttatcagagaacgttcacaaagacattagagtcaaccatccattcctatcacatccaatcaaagtgacctaaagtttcattccctttactcccagacatacatgacatggttcagaagggaaacaggatctgggtaatgtcaaaggttcaccagtgtttgtaatttcataacccttgaaatgaggaaaagaaagaatggcaggcaaccttccaaaacacctactgatatttactcatggaaaacaaatagtcttgagtgggagttccaaagccagcatacaatacaattcacaagtattttcacctcaagcacctaataaccttactaatgaaatctggtgagcttcaacttgttttccatggtctgtacagaaagaagtacttaacaggaatcctgtaggaatctttcctttcagactaaatcatagtctgagtaccaataatcctcatttgttttaatagcatctgcaatgattttgctttttcctaaatattcttgaaaccagtactataatttattgtatatgcaggaaaaacctcatcttccaaaagacagagacttatattcctgagggaggtgtcagggtgtctgaacattaccaggctgagtggtagccccacagagatgagttagtgcaagaatcccaggcctcctactgatggccacagcccagccctgtttatgccaattccctccctggctttggaagtggctgtaaaacctgttacttccttatcatctctgtggctcagttacagtacaaaaaggggtaattaatccttgggctgcaaacaacagacttgggcgtgggaaagagaaaagaattttgaaaaagtgtaaataaactttgtgccctgtccttttacagtaaaccagaggattacagccccgcccatgggccagatttttagagagctcaaaatgcccatggcacacaccacactgcagtcgaaagaacttggggcatcccttcactcattctccgcaattcaaaatttccttggcaaatgggttgaccaatcatcacagaacagctcttgggcgtttgggtggggagagggacccagacttaaccatccactcatggaagcaacaccatagtctctcaaccaggcagtgaccacatgcaaaccgtaccgagtaaagcacattctgtgactacttgccaatgtgttgtgtcctcataacctgacctcacattttttaggctttcttaaggatcatcgattgatattataattaaaacgacaaccataaaaagggagatcaagaaagtaacaataaaaccacagcagctatctaaaattgttacaccatattctgcctctacggttccaggacgtgattggagaccaacaagacaaatacttggactgatatcagatgatccagcgattttatcctaaacaccaattcatgcactaattatggatttgattgttgacatgatataaggtatattttcccaaagtacaatttgagattgctaacatttgcttgggaaaaatatcatatatatgtcacacttattttagcaaatgaggtttgataaaaagtagaaataaaactggtaagtacaaaataatattttaataacataggaacatgaacatgaaaacaatgtaaacaggttagaatttttgatatgatactacaaacgtgattttgatcgtacgcaactggtaaaattctatgcaaaaggattaacaaggcatatcataggaaatcactttgcccaatataagcagttctcagcacatactcaaatgcacacaaacatgaaaatcggaaataaaggaatgttaaaaaaataacttaggcagacacaaataaaaccaccccactagtgtatgaatgatgcatgtttttatgatcttaattacatttaaggatttaaaaaatgccactgatctcacagtttacaatatccaaatcttcaaacctgctggaagaagtccacagcacagcctggaaattgcatccgttgcattctctcgtgcagttacctgtaaaccaaaaatcgcagtcacgactttctctaggtttaacaggtatgtcaatcaaaaaataagcttcaattctggagaagttgataggggttgaaaaggctatttgatatcaaaatgtcataatttatgcttatctataagggatcaaatcttacctacaccgagcaaacagaatctttcgaaaaatgtgtgattcacaagatctttccttttaattcaaagccaaataagtagttcagtctttcactgcacaaacaggaagggcgtttgatggaattacagcaggtaaacacaatctatgttagtgatggcactgggaacctttgactacaaaaggtctcatgcatccccaaaaagagcactgagggtactcaagtcactgtgagtgctggatcactgagctgttggtctattctggtctggagaacaatgccaaacccttgggggaaaggactttgaagatgtgagctatcctagcaagtactgcatcatctcactatcttaaaggaagatcgtgtctccttcactccatcactgggcctcaagacaacatcttgtcctcttgtccaggtaaggcctggacctgccatgcccctgcagatccttccatctttcatctttcttttttctttttcttttgtttttttttttggagacagagtcttactctgctgcccaggctggaatgcagtggtgtgatctcagctcactgcaacctccacctcccaggttcaagcaattctcctgcctcagcctcctgagtagctgggattataggcgtgtgccaccatacctagctaatttttgtatttttagtagagacaacgttttaccaagttggccaggctggtcttgaactcctgacctcaggtgatcctcctgccttggcctcccaaagtgctgggattacaggagtgagccactgtgcccggcagattctctcatcttgttttgatagtacagactaagcactgggatgagaaggggggtgacttcttaaagacatgctacttactaaaaacaagtctttttcaaaacttgtattatatccaagcattttaataaagacaaaggccagacaaggaggctcacaggtgacacaacacaaactaatcaggagacaagacacctgcttatgggctgtaccttctgccttgatatgtagtcagttcttcctgaaggatggaagctctcttttgcagaaaattaacctagaaaagacaccttgtgtgagaagaggtggacgtggcttacatgtcaatattgtgcaaatagtatggtaagattttatttaaattcagacaattccctagataaaactcagaggatttgttgaatgtcaatgttgtgttttttacatttggtcacatcccatccttattgaaaatccatcagttacgacagaataaagttcaaactcctcattgcagagccattttgatctggcccacccccatcattgtggctttacctgtcctcacgccctgcccaccactgctgcttccacaccgtgtctttctcgctccgttgctctttggcccaggccattttctctctttggaacacttgtctttctgtctcccattcatcctccaccatttggtttaaatgtcacctctcctgtggaatcgttcacctcctccccagctgctccttgcctcctagccccaggcaaagccagcggtcccctcctctgtgttcctcccctctattactggtacttctcaaactgctttgtggttatttgttttcatatctcttccctaaacctgagagcttctcttgggcaggaatgacttttctgtctttccaccccagtttcttttacagggctgggcatgtagctggtttcactagctgttgaatgaatgaatgaatgagtgagtgtaaggaaaattactgctttctggaaacctcaatccattctagggattccctgaggttggagagacagaacttcatagcggaaagagcctgagctttgtctggagttaggccaactttggttcaattcctggcttgccatctgtggctctaggaaaattacttaagctcttgatgcttaatctgtgaaatgggattaatgacagctacttcccaaggttatgaggatgacatgaaacaactatagaaaccgcctagtgcagagctcaaagcaggtacaacccccagaccgccattcttagggggctggaggaaactgggttgtttagcatattctcttaaatcagacctttacaaagcatttgattattgtgtagcatacatttctgtactgttaaagatgcctgtatcaggcgtggattcaaaagcaccttacacaacccaaatggtttggggccaacttataccatggcttaatgtaatcaagagtcagtggtatttgatcgtttcagaattgtttattcttacgtctttggtctgaactgaaaccatggcaacggttgatcccgaaacatagttatgcaagggagtacagctggcagaacagaaaatgtgcttgaaagagaagaaaacacagtctttctaagtgggtgcatctcaaagtggtcctcctggttttgcttatttgtatagcaccctggtcttcattttatccaattgctcaagtgacccataggacaattgataattttgacagatgcagggattacactgattcaacttccctcccccaaccatgctctgtaatcggaattccaacaattctcaaaaaacacaggcacctgtgctttcaaactaaatttgctcactgtatggcctgtgactcctgcgtgcagctgccaactctgaggccctatcgcagctggcagcactctctttctgggtcagcatccagttttaggaggctgaagtggcttttattacagtgaaatgatatgaatgataacagaagccctgcaggtgggtatcagattcctttttttttcctcttcctaaaaaaactcctctgaaggcgtcaggtcctacatagctgacactatctgtagctcacctacaaacttaatgggtaaaccacacctggagtggagattttcatgtaaataaaaattatttaaccctttgtatgttcccattctcctccactacttatttttatatgcaggcgtgaacaaaatttcatagcccttagaagcaaaatcgcaaacagtagcatatggattgagattatgaacatttcattttcagataagagaagttttactaggggaatataaaaggaacagctaaaatgtgttccacattttatcttacatactataaatagataacgtggatatcatcaaaccatatcatttattttattcataaatatatttattaagcacctgttatgtgccaggcaaagtacttgatacagggagtaaataaatcctttccttcatggaatttttcaaggaaaaaatatgtcttaaacttcaaagtgggctgggcacggtggctcatgcttgcaaaatgaggctgaggtgggcgaattgcttgaggtcaggagttcgagaccagcctggccaagatagcgaaaccctgtctctacaaacaaacccccgtttctaaaaattagctgggcgtggttgcatgcacctgtaatcccagttacttgggaggcagaggcaggagaatcgcttgaacctgggaggcagaaggtgcagtgagctgagatagcaccactgaactccagcctgggtgacaaagtgaaactctgtctcaaaaaaaaaaaaaaaaaatcaaagtgtattggagatgtgaatatgtaaactctttctcatgataccaacaatacgtaaaacattcaaacatgttagaagtttttctcacatcgtgaaccacatcacatttcttttttttctctctttctttcttttttttttttttttttgagacggagtcttcctctgtcacccaggctggagtgcactgggcgtgacctcggctcactgcaacctccgcgtcccaagttcaagtgattctcctgcctcagcctcctgagtagctgggataacaggcatgcaccaccatgcctggctaatttttgtatttttagtagagacggggtttcaccacgttggccaggctggtctcaaattcctgatctcaggtgatctgcccgctgtggcctcccaaagtgctgggattacaggcgtgagccactgcacccgaccatatatatatatatatatttttttttttttttttttgagacagtctttttctgtcatccaggctggagtgcagtggtgtgatctcggctcactgcaacctctgcctctggggttcaagtgattctcctgcctcagccttccaagtagttgggattacaggcacgggccaccacgccccgctaatttttgtatttttagtagagacgggattttgccgtgttggccaggatggtctcaaactcctgacctcaaatggtctgcctgcctcggcctcccaaagtgacaggattacaggtatgagccaccatgcccagccaagaaccacacatttcaacaagaactatttaacctaattgtttgaataccttgtcattattttgccttgaacttagaatacatcttgttatctctaacgaccatgtaaaatacaccagaataaaagtgcttctaacataactgtgctttcaatttctctgcccttctgcacagtgaggaatcagccatatgctaagtgatggcattttggacctgataccaagaataaaaggatgaggctatattggaaggtagactgtaaatgaattgaagttataactgactgaacttttcaattttaagggtgctttaaagaaattcttattgagacagtgagttattaaacaagtaagaaaaaaatttaaaacaaaatgaaaatttatcctgagtagtaggttatgcaatgacatcacattgatttctggcaacaatttggaatcagatttatttgcaagtttcttttcagagtatcccctaaatccttggaaaatgccttgattctagtaattacctgtgattttagggaggaaatggtgtcttcaagttcttgtcttagggatgctggcatcaatcctttcaattttgtttcatattcttgtcgtatgtaagttatctaaattggaaaaaaattaagagttatctttttaccacataaatgattgttttggatttaagaagtcccagaacagatctgttcatcacaatgaaaggtttgttacacgcggtcagaaaccagacaataaagatgaaataagaagaaagagttaaaaactgaaaaggctacccagtctgaccctgtgactctgagagagatggtccctgtaacaatgctttatttatttaaaatcctcatgaacacaattttcagcatctgataagtaaaataatttttctctcctcttcactcatgaggttccccactatgctagccctgcagcctctccttgatcaggatgtgaactccaaccatactaagctgtcatctgaggacaactcatagcatgtctctgctttgatgaaaatactccttgagggggtggtggctcacgcctgtagtcccagcactttgggaggctgaggtgggcagatcacttgagcccaggagtttgagaccagcctgggcatctctaaaaatatataaaaattagctgggcatggtggtgcacaattgtagtttcagctacctgggaggctgaggtgggaggatcctttgagcccaggagatcaaggctgcagtgagccaagatcgggccactgcactccagtctgggtgacagagtaagactttttccaccaaaacccccaaaaatccctactcctccaaactgtcaggtagttggggcactaaatgtgattcatataatcatgaagacatgaatgaaggagaatctgcatagctgtgtctccgaccctctttgacacaagtagacaggtagagtgcactgggcataggaaggttcctggttcctggtttctttctgcctcccaaatactatcgggcctgtgtttaactaactgatgctcactgggctagtaaaaaaaataggttggtggctcatcccattcatctctctcaaggctaaaggagtgagtgagagggtagaagaaaagcctttggaagaatatgcctgagcaggatgaagatgtgcatggatgaggcgtgaatatgcatgtgtagatattggtgtctttttccagctgtgtttctgcatttctcttccacctactgtgaaataggatagaattaattattttaaaaatctgttgcatgtgctgtgcatgacttaaccaaacattaaagctgagttgcagtgtatcataccaagtgattcatcatacgcacctggaaataggcaatatactatgaaaattgtgtacgactgagttgagttggataagcctatcaatttgctgaagacaatttaaaattaacagtctttaagaccgaacttttcttacactaaactgaattaaggaaaaaatgtgcttaacaattcatttcattacctactaaaatcctgtggccactgttatagaacataaattttcaatttttggcaaagtgctttttttgggatatgttataatcctgtgacttatacctaaaggaaaaaaagaaataataaaacatgatctctcccacagatgcaaagtctttgctgatgaaatatctgttgattctcctgtctactgatttttctcaccttctcttcttcagcttacctccaagtgagccagttccagctactcacttacttgagtcagttagctgattcaaatgaaggaaaaatgcaaagcaaaacgcatgctttataaaccagacctcagggtaacatttattgagggttcatgggttatatattgactatttttttttctatcactcaacactggttctgaaagtttgagtttcaactcttttaaaaacaactcatgcatgcgctatttcctttttaaacaaattttattctgtattttactactgaaatatgttgtcctacccatcccaccccacagtaaaaatctcatccaggctccctatttctttcccttatcccctcttccaccacaccatcccgggacaagtgctccaggattccctgcccactggccattctggagtgtgtcctttgggtagcaatgtggaaaccaccagggcctttgtggagaaaatggagggggctgaaggagtcccaagaggggcttattggagggccttggatccttgctcataggtgagcttgatctcatcatctggacaggtggaggcagattcttcctgagcataggcattgctcaagtactgctgcacgccctggaaggcctcagggatggtgaatccctggtattttttttttcttttgagatggcatttcaatctgtcgcccaggctgtagtgcagtggcatgatcttggctcactgcaacctctgcctcccaggttccagctattctcttgcctcagcctcctgagtagctgggattacaagcacgcaccaccacacctggctaattttttttttttttttagtagagatggagtttcaccttgtaggctaggctggtcttgaactcttgacctcaagtgatctgcctgcctcggcctcccaaagtgttgggattacaggcgtgagccatgacacccgggccccctggtacttcttacacaccacttgtactatgtggagcgttagcaacaggttgcagtcagccagggtgagctcattgccatccagaaacttcctctgagagatgccttcatcttcagcactggtttcatccacttcttctgagtggcaggatatcaagtgattgtctaaaaccttcagggctttcaggagtcccttctccagattgtcattgactactgggtttgaattcttgatgtaagcagaaaatttggcaaatatgtcctgctcagctgtgttggattcagggttcagagctgccagcttggggtacctaggagggcacagcactgcctacagaaattcctcaatcttgttggtgtccttgtgttcttccatgccatacagcaggaatgggagctgccctcctgggcacagcttttgcactatcttggtctgcctcttggtgtcaatgatggtgacattgaaggtgactcccttgagccacagcaccatgaacagtctctagaaggggcagttcccaatcttggccccatcactgccagccttcacgaacaattcaacttgcagttgttcttcagctatggttgcgttggggaccagaaagtggccatagctgggggaactggggcatgaactgtttcttacatccttatctgtttagaatgtctatctgttttcctaagctggcactcggcaagaaggccatgttccatttgagtgccaagatggtgaagcccaatggtgagaagccggacaagttcaagtctggcattttccagggtcttctgaagctggagatgaactcggacctcaaggcttagctcggttgcatttataatgcagtccttgaggattcggtcttctcacgtgaaactggatggcagccagctcatacaggttaatttggacaaagcacagcagaacaatatggaacacaaggtcaaaactttttctgatgtctataaggagctcatgggcaaagacgttgattttgactttccagaatttcaattgtaaacacaaattataaagtatattcacagtagaaaaacaaaaaagtctatccattgcctgcatatttaaaagacaactttgctgggtataaaaatgcttcaatcccactttctttctctcataactttgtgaacacaaagatcaagttagctaggcatggtggtgtgcacctgtagtcccaactacttgggaggctgaagtaggaggattacttgagcccctcagaacatttctccagtgttttctggcattacatattgccatggtaaagtctgaggccaatctgatttttttcatgttgaatataactttctttttctgcttggatgctatgattttctttttccttcatttagtaacttcactgggaaatgctttgatactaattattttatattaattttcctgagacattgtgtgccctttctacctttacattgcattatttgaacagaagtttcctttgttagaataattacttgtattttattatatatatatacttatatgtatttttttctgttggttctcttcttcagagacacaaactttgcatgtgttgacccttctttgacaatctcccataattatacattttatctattattacttttattttcatatcattttattttgagacagggtcttgctatgttgcccaggctggtctccaactcctggactcaaccaatcttcctgcctcagcctcctgagtagttggaattacgtgcatgcatcactgcaccaaactcttcttatcgttttatatctattttatattttcatttcattttgtataatagcctctagcctaattactatatttccttggatggttttagttatgatttttctatttttgtttcatctactatggtttcaatctctgtaatcttttgcttttgtctaccatttttcctaagctctgagagatcacttttcatctgtctgttgacttatatcatctttagatatgtctcttcttttttctatttctctatctccctccaccattttccttgtgagagagatgtttaaatgtgttttgtgaatgctttgacactgtgaagagctgttataaagaactgtaattagtctgaaccttcctcctgtaattttccatttgatatacagaacagtatttgcttacattctttcttctcctctcttttaatccagcaaagatcatatgctagttcctttttctaaaagaaaaattacacctcctttttgaatggaaccagctatttgctgagagttgaggtgtggtgggggcagctggggtcaggccacagctatgctttggttttgtcgtcttcattacactttgaccaaatctatgatttcatttgctctgggggcctatgtccctcagttttcaagtactttggaggtcacggccaagtacttaagccctttggttcacgcttatggttggtttctcttgactctccttcctcctgccctgcccactattcacatgtgatggtttctctctagtaggaggctaggccatagagagtagaagattgggtgtgactaaggttgctctttgatcgccattattccttccatcacttttcaaattcagaagttatattttccaacatttattgaagattcgtgcatttatacttcctgtctactcctttattcttagtttttgtgattttagtgagtttgaatgaatttaaaataagcctctggaaaatatgaaattacctcatgtgtgagtgagactgtcaactgggaaaatattactaccctgaattcttaaactcaaatgctcaatttaaaaatcattatgtaaagctgaatcctgttacttcaataaagtcatgaaaaactttaaccaatctgttttcattctatttatgaggttaataaaattatcacgagcaaacatttactgaggactttctgtgtgccaggtgtgactctccatgtttttatatggacttaatccttctgatgacccaatgagggaagcatagagaggtaaaacatgatttgaactcaggtagtctgactctcaagcacatatgattgtccactttgctctacagtttctcaaataatccttctaaatgctgagctgatttttccaccccagggggaagagaatgccagagacacgtgggttagaggagtctttgctaccacgctctagtgctttccccagcacaacaggggccagggccaggggatggggcgttgaactgcagtgcttccagacatccatctagtcagcgatctttttaaaaatgtgacaacaataacaatgacaacaacaactggttccagaggactccccacgccttcccattgattttaaaattttagcttactacagatttatatacgaccaactgaagaaaacctacacaaatgcaacgtatatgtctgacctaaaataaaagtttcacaaattccccaaagaagcacatattcaaaaatccaaccagtgaaggatacatgtaaatttgtcacatggcaaaatgacaaaagaaaaggaaataattagtttatattcctatatatcactcttgattcttgtttttttttttttttttgagacagagttttgcttttgttgcccaggctggagtgcaatggcgcgatctcggctcagcgcaacctccgcctcctgggttcaagcgattctcctgcctcagcctcccgagtagctgggattataggcatgcaccaccattcctggctaattttgtatttttagtagagatggggtttctccatgttggtcagtctggtctcgaactctcgatctcaggtgatccacccaccttggcctcccaaagtactgggattacaggcataagccactgtgcccggccttttttttttttttttttcaagagacagggtcttgctctgttatctaggctggagtgccatggcacaatcacagcttattgcagcctcaacctcccgaggctcaagtgatcctcctgcctcagcctcccgagtagctgggactacaggtgcgtgccaccatgcccagctaattttttttttttttttccccatatggatagtttctcactatgttgcctaggctggtctcaaactcctgggctcaagtgatcctcatgcctcggcctcccaaagtgctaagatgataggcataagccaccatgcctggcttttgctactgcttttctatccccacctctgacccaggctgtgtttaaggggaaacaatgagagaatgagaacttttacctgtggactattcatgaacttggaactgcttgactatgaaacaatctggccttacaacagaccatgaagcaagatgaggttgagtggagttaagcaatgggtttgatggacacaaaattcctttgattcaagatcaaaatttttactcatacatgtattttattattatatttgaatattaaattcattagcataaagtgtcctattataccagtgagtgatgtctattaaacacgaaggtattcaaaggctggtctgctgtggttcatttccatcctctctccattcccatcatcctcaaaaagcactgtggataatcacgtgctcttccacatccctcaaccacatcgcaccaaagagaggggcttccctctctccaccacggttacttctctctctaccttccttcatcttccttcctttagcaaaataaaattaggaaactcactcaggacattgtgataatgacatttctataactagtaatgactcctgtaagctgagtggaaatggggtctttataacatggtgcccatgtgactaaagggctgtgccctgctccatggcaatagactgcccacttttccctccaaggcacggcactgacactatgattcccttaacttttaaagtgaactgtgaagaccaagaccatccctaactagagtttcatgttccaatcaagtagaactgaaatcaagggtaatcagacaaatgatcatttgcataaataatagactataaggtgtatggaatgtgcagttgacttgagccaaagggtccgtagagataaaaattcaaagtgacattggaaaaaaggagccttgaaaatctataatttcattaaaaatagcgaagggagaactaaaacatattttatgatgtttttattcaaaaaacaccacattgaccgggtggactggctcatgcctgtaatcccagcactctgggaggccgaggtgggtggatcacctgaggtcaggagttcaagaccagcctagccaacatggcgaaaccccatctccactaaaaatacaaaaattagccaggcatggtggcaggcgcctgtaatcccagctactcgggaggctgaggcagaagaatcgcttgaagccaggacgtggaggttgcagtgagccaacatcgtgccactgcactctagcctgggcaacagagtgagagtctgtctcaaaacaaacaaacaaacaaacaaacacacacacacacacacacacacacacacacacacacacacacactgtatcaaccaatcatgtcaatatgtcaaaaccatgtcaaatatgtcaactggtttataataaaacaaaaactaagatggaaatgtgcagctctgtgcaatcagcttaggcacaggcctcaaatgcaagttattttattgcaagctccaatgtgcctaacacggaattgtcttttgaggagctgagaaaagaggaacctcctattccattgccactggtttatgctacagtggtggtttatatgtctctgcatagtcctttattatcatattttgaagtaagggtgaagcagttcaggaaaataagtgtgcatgaggccaggtgtggtggctcatgcctctaatcccagcactttgggaggctgaggcaggagtattgcttgaactcaagagttcaagaccagcctgggcaacataatgagacctcatttctactaaaaataaaaaaaaattagctgggcgtggtggcatgcatctgcggtcccagctacttgagagtctgaggtgggagggtcacttgagtccaggagatccaggcttcagtgagctatgtttgtgccactgcacccagcctaggcaactgaataagaccctgtctcaaaaaaaaaaaaaaaaaagtgtgcccaatattactttacaaagcccaacaagcatttctgggggcagttcagcagagaaaaaggggaactaagtaaaaattctatggatgttatctccttaatctctttccactttgccactggtaccatcccaatccagaatacattcaatacattcatcttgcacctggatgactgcaatattggtatgttggttttgcttttcaagcagaatttgcttaacttttaagatcaaaattaatatcctgtatatggccaacaaggccctgtactgtctggccctatccacctgctaacctcctgcaactccagagagtcacctggcctctggaataccagacatgtttgctttcttccaattcattcaccaatgccctgtgctttttctcacaacaggatggttcttgttttttctctaattcttctttcttgttgtgtggggttttgccactgtgtccatctggacatctggatgttgggggcccctgctctgtggtgatgtcagggagggtgcagatctaggcacccagggggagggagcttggccagaccttcatgatgaggctgtgttggggccaactgactcccctttagacaagccatatagccctgagtgtggcaggcatgagcttcattagcaaaaacgggccccacaccagcccttgctttcaagctgcaacccaggctcctagcactttcctggcaaggagcacttctagcatttttagcccctgtcatccctaacacgtttcctcccagctgcctctgcttgctgctgggctcagtacctggaggctgtggcctcactcaccacttgggttctgctctgtttctacatcacagagatgttcgtcttgcttttaataccaaatactggccaggagcggtggctcatgcctgtaatcccagcactttgggaggccaaggtgggcagatcacctgaggtcaagagttcaagaccagcctagccaacatggtgaaaactctctactaaaaaaaaaaaaaaaaaaaaaaaaaaattagctgggcatggtggtgagtgcctgtagtcccagctactcagggaggctgacgcaggagaatcgcttgaacccaggaggcggaggttgcagtgagccaagaaaacaaatccatctttctaattctctctctcgctctcttttttttctctctttctctatatattttttatgtatatatatattttatttccataaggtttttggggaacaggtggtatttggttacatgggtaagttctttagtggtgatttgggaaaatttggtgcaaaccatcacctgagcagtgtacactgaacccagtgtatagtcttttattcctcgcccccttcccaccctttctccctgagtccccaaagtccattgtgtcattcttattcctttgtatcctcatagcttagctcccacttacgagtgagaacatatggtgtttagttttccatccctgagttacttcacttagagtaatagtctccaactccattcagggtgctgtgaatgccattaattcattcctttttatggctgagtagtattctattgcatatagaccacagtttctttatccactcattgattgatggacatctgggttggttccacgtttatgcaccccttgtgaattgtgctgccataaacatgtgtgtgcaagtatctttttcatttaatgacttcttttcctctgggtagatacccagtagtgggattgctggatcaagtgatagttctactctctcttctttaagaaatatccacactgttttccatagtggttgtactagtttacattcccaacagcagtgcagaagtgttcccttttcattgcatccacaccaaaatctattattttttgattttttgattatggtcattccttccttcctctctttctttctctttctttctccttccttccttccttccttctttccttccttccttcctttcttttctttctttcttgtcaagtctcactctgtcacccaggcagaagtgcagtgtcatggtctcagctcactacaaactccacctcccaggttcaagtgattctcctgcctcagcctcctgagtagctgggattaaggcatgcaccaccactacacccagctaatttttgtatttttagtagagatagggtttcaccatgttcgccaggctggtctccaactcctgacctcaggtgatccgcctgccttggcctcccaaagtgctgggataacaggcatgagccactgcgcccagctgattatggccattcttgagagtgtaaggtgttatacaaatggcaaaaaatgctcaacatcactaatgatcaggaaaatgcaaatcaaaaccacaatgtgatctctttttatattttatcaatcattgtagagtgtttggagctgagggggtgcctggtaatatgagctaatagagccatctagtagaaaaggacagactcttttgtaatcttttgatttaataaagtgtagggattaagagcccagatactgaaactggggtatctggagttgggtctgagttgtgcccctaatctgtgtgctcccagaaagagtaacttctctgtgcctcagttttcttatcaggaaaataacttttcaaggccaccgtgaagattagatgatttaacacctgcaaaatttttataagttgcacataatagatgttcaataaacattagttatcattatatgacttaatggagatttttattatatatatttcattatattatgtatatagcatgaattacatttatatatatattccatttagccaattctctatcattagactttattgctatttctaattatttgcaacattagaaatccttatagcaagttatttgcataaattaatgattgaggactccattgaaatgtttttgtattttttagtatctgtggattgagaaagtaccttaccaaaagctcctatgaatccagaatcaattttaaatgaatttatattttataattcaaaacaatctatatatatttgaaaaacagtagtgcctgtttatccaggataccaacaatggctagtgagtgtcttagtttgggctgctataacaaataccatagattgagcagattaatcaataagcatatatttctcacagttctggaggctgaaagtccaagatcagggtgccaacatggccaggttcttggaaagggctctcttcctgcttccagtttacagcaatgtgtatgtggacctccccatatggcctttccttgatgcgctctggtctctcttcctctttttataaagacattcatctcattatgggggacctaccctcatgacctcatctagatctaattacctcccaaaggccacctccgaataccatcacattggggattagggattcaacatatgaatttgggaggggacacaaacattcattgtatagcagtgtgcatatgaattttctcagatccttgtcaataactctggtccacaggtggggaaccattgctttattgtaaatgacttaatttaagggaaggatctcagctcaaaactctctttccatctggatttccaccaatacataggaggattaagggaaaataacatatacttctactccttgtggattattcagaaactgttctttgaatgtctggcttagcagaatgtgttaagtaaagtgagtttgactggtgggtagattgaagggggcaggaggaggggagggagaaaaagaggtgactttggagcatggcgtgtactctgagggagggtggacaagggcaggcactgcaattggccatctggtgtaagaagagtgcagcaaaaagacacagggcttctgaagggtggcgaagggccagaggaggtgggcaggagctgggcacaggaaggcttgctgggagggatcagatgtaacataaacaggaatgtggaggatgtttctgagggatgggcctttatgcagccaaacgtttttgcataggctttttaggggaatgagtatattttggtttcaagaataagaatgagggctgggcacgtggctcatgcctgtaatcccagcactttgggagccagaggcgggcagaccacaaggtcaggaggtcaagaccagcctggccaacatggtgaaaacccatctctacgaaaaatacaaaaattagccgggcgtggtggtgcgcacctgtagtcccagctgcttgggaggctgaggcaggagaattgcttgaacccaggagacagaggttgcagtaagccgagattgcgccactgtactctagcctggcaaccagagcaagactccatcaaaaaaaaaaaaaaaaaaaaaaaaagaataggaatgaaagaaatagtagtaaaagatgatgccaaaaaaatgctgtagtacaggtgagaaaatgtaccgccttctaagaaattccattcttattggggttaaagtatcatgtgttgccacagcaactgccaagaaaaatccgttttaagaaaggtgctctgctgcagagctcatgtactttgattctgaagtataaagtgaaaatgtagaaataactgcaattttcttaacaatcttaaaaatattcatttcccgcctttcttcaatatcatttcctcttcactttctttattctaactggcgtcctctcaaactaagcgtgcagcgcaataggagtcctccattccctgttcataggaaccgttccaccgcaagggagtgaagcctgctgcttaacaggcctgggactccaaggcaagcgggtggctggtgcaggaagcagttgccgacctctgttgtttgaaggtggcatgaactagtttctggaaagggttatattttcaggaccattttctgatcctgtggagaaaaaggtggctttagcatgagtgaatggttcaaacctagcactttaattaggtttaggtgctctaaatccagcttcaggtagttcaaaagattctctgacaccaaaaagaaaacaaaggtctggtaagtctgcctctaaggattcacacacagaggaaagacagaaaatggataacatagtcaaaggccagaaaattactaataaactgtctgaatttgttcatgaatcaaagacttaaattctgaataagattgaggttgtcactggggtcgtaccatggcagcaaagactcagaagaggaactcggacagcgatccatcctaaagcacaaattattgcggaagccgggccaatagtgattggcaaagggaacctgatagaagaacaggcccttatcataaatgcttcctcggatagtatcactcttgacactggagatccagaaccaaaacctatgatcattggcaccaataatgtgtttaaagttggcgtcattcccaagccatggagatgggagataataatgtcattgaattaaaagtgtatgtaggcagaaatctaatattgacaagtggctgtctcactggcgcttgttgcaacctaaacacttttgaagtcatcccggagaatacggtgatctatggtgcagactgcctttgttgggtgcaggctgagcgaccgcagcctcagacactacagctggatttctcgatgaaaatcttgccaaattaccaccacctaaagaagactacgaaaggaagctcaactccagtaaagaactaagaacagtacatgacatgaagataacattttgtctttgactgctgtcttttgaatgggccacagtgtttatgtactcttagcagctcacagaataatacatgttgactttattttgtaaaattgggttgagaggaaagtaatggattttcattgtaactgtcctttataattcatgtaaaatgtattattttcctttatccttgcttcttttctgataatttacagatttagcttttcttttgttatataaactgctagccacaaattttagttatgtaaaagactacccattacaagaaaggacatattgttatgtatttatattctggcataagctaaactgaataaaaatactggtaacaggaaaaaaaaaagattgaggttgtgatgtaaaataaacacatgtgaatattaaaattttggacagtattttgcatataagcaataccctttacttcctgatggagatggaaaagctaaaaccatattacagagctcctattaataaatgtggccttgggaggtactcatttagaatttctcaagacacatgtagcggagattttattcagcagcattcattccagcatttactccagcattattcaccagttttctggtaactggaatctacccctctcccattctctgacccacccaagggtcaggggtagagtatgtgacgggaccctaaggcaatcatcacgtcgcattatctggagccataactattgagggcctggtaacatgatccaagtccaggtaaccagagtcactgacagtcaaaggatgcagactctctcatccactggactttccccattgatgtcattctggaattgtgacaaccatcttgctaccacagagtaagaagtgaactgagggttttggcaatccaggggaagaattgagaagtggagaaaaataaactaagccctttatcaatctgtacctagagttagccctgtctttggatttttcagtttgggttagattttctgtcacttgcaacccaaacggtctgaattgaaacaacatagaatatgcaaaatattcacttacatttatgcgtgttgcatctgttagaccaggggtcaacaaacttcagcctgcagaccaaatttgggacactgcttgtttttgtaaataaagttttactggaacacagccatgctcatttgtttacttattgtctgtgattgctttctcatgacaatggcagtattgagtagtcttgacagagaccttatagctcacaaagccctgaaacatttgttatctggccctttatagaaagttggctgacccctgtgactagaccaagctccactaggtagggactgtgttcattttgctgactgctatggcctcagcatttagcatggtgcctggcatatggtagcaactcaatacaataaatatttgctgatgaatgaacgaatcacacagagcttacaacctttggtgttaagtcagtctttgtctcaaaatgacaaggtcttcggaatgtctacagtaaactcatcacacatgctctccctaaagacaaagagaagattctgtcatctcagtattgcagttcttaatcagcacagtggctattaataagtaggctggcttcaaagctgagaaagtcggaggcaaacaccagggcctacggggctgctgagatcaaagaggatcttagagattcaccccgaaggaggggagttggtttcatcatgctctttcctcctctgtgcttctccagtttactcactatcagactttttatatatggttgagatagtcaatgactcatgcctcttttcttctaaaaccaaatgccagctcctttcttgctagaatatataattttggtctcatttctaatgtttttcttgttaataataacattcctaatattttttctttccttaggttgatatatactatgaatactccattcttttaaagaagagctggtacaggtcctaaagcagtttgagcagtacagcaattctacaggcatgggatgagaaaggctgaatgtggaaagtctggacaggtacatgttgaagaacgtgaatatttggaggaccaagtttaaacaagttggaaggaagcaccttctctatgttgcaaggtacatccctgaaagcgtttggggaaaacctgggggagggatagggtgtttttcacttctgtttacaatgtctgactttcctctcagaaagagggtgactaggcctttttggttggggctggacttcctaaaaaaggtagttttcatcaacaaaggaccaaaaccccaaccaaagggtaggtgagactcttgaggtttataactgactttgttaataaaagacccaagaaaacctatagaataaggctgatactcagtgaggctgatgggggttttggagtctccctgatatttacaatttatacatagaagtaaggttggagcactggacacatagcaaatgcttagtaaatattgttttaatgagtaaaaggctgaacaaagttgttgttgaataggtaggtggcaccttgaaattatggaaggtagtaaaggttatgtcaacaaatttagattgaatgtagtaaaaaatagaaaaagcaaagaaaaccccacattatgaacaccttatatgtgccagatactgtattaagcaattgctgcataatcttttacatactgtgatgattctatttaattcttacatacaatttggaagacagacattatctactcactccatagagaaggaaacaggtacacagtgcgtaactgctagaaccacgattgaaacctgacatctaagcctgtactgtgcccatttattactgggaggtggagaagggaataggattgatctggaaatattgtgatggaatctcaggagaggagattctgggattcaggggggcagctgggagctgctggagtgatctaggaaagtgaggaactcctagtctgatctgaggtgatggctatgggaaggtcataaaatagaagctgattaattacctgtctcatagaatagaagcaagagatgagttgtatgagaatatatgcttcagccatgtgcctagaagaagggtgatgttcctgcagagacaaggcaatgggtacagtacagggagttggtctgggtgtaagcaggacacaaggtatgtttgggggtttgcatttacttagtttgaggagcagaggaaacattcataaggaaatatgcgagtagagctcaggagaaaagcaggactagaggcccaagaatcacaggccagaagaagaagctgtagcctcgggaatggaagagctctctgaaggggaaaggggagaacaggaatgtcccaggagccaaggctcatctataagggacttccacatttaggatgtagaagaaggaagcagaagcagggaatgaccagaaatggccccagagatgagacgaaagttaggagagcggggagcaagcctttaggtttcacaagggaaggagggaaagtaggtgttaggtgctgccaagatcaaggaaaataagcagaagaccaggccatttcagttgcagtgagccaagatcacgccactgcactccagcctgggtgacagagcgagactctgtctcaaaaaaaaaaaaaaaaaaaaaaaaaatatcagaccatttctatcccctgccttgaatatcaccaccgcataggaaatagaatggtctagatagcagattaatcacgacggattttggtgatcaacagtgctacagataaggggagtttaagaagaaattaatttgttgataaacatatagtttcctattttaaagcaaaacttaaaagatccacatctaaccttcagttaaatatcgttcaaaatatctgatttagacagagagttctgacctggtttgagggcatttttcaaaagaggcaagctacgactgctctttcttttctgcatatttaaactcttgacaattataaataatctaaacctctccctcaaagtaccaattatctccttatgtttgagaaggcatgtcttgccagatatggtattctatacaaaacacaaaataggaagacaaaggcagccgttgtcccaccggtgcaccccggatttacttaggcagctcgatgaacgctaatgaggattttgtgcatgaatctcccaccttccagctaaagggaactgagaccccacaacctcacagcagaacatttcttaacaccattgtaaacactgactccattcaggagttgttcacctttacacagcagagagaaaagaattttttgttcaattaaaacttagggagtgtgacgtcatcaaaatacttcctttaggctttctgaaagaaaaaagcttatactttttacacgagaagtaaaaaggagcttcagaaatacataactgacatataataggccaggaagggaacaggagacatcagtaactcctatgtgggataatggaggccatcacagaggtgatgagatttgactgggacattgaagaatgagtaggaactttcaagatggatgagaggaagaaaaaactgctagctgaggaaagggcaggaagcatagaggtgactgtgtgtggcatgcttagggactgtcacagggtagagtatgggtggaggtcatggggtgggcaggggataagtgagataggtggagacaaggtggttaggactttgaagcttatgccaaggtacctgggctttattctgaagacaatggaaaaactaactcaaggtttctgattggagactaatataccttgatttctccttccttccttccttccttccttccttctttccttccctccctccctccttccttcctcttttttgttttctttcttttttcttttctttttctccttccttccttcctccctccttctcttttctctctttctttcttcctttctttctctttctttctttttctctctcgttccttcctccctccctcccttccttccttccttcctccctccctcccttcctttctccctcccaccctccctccttctttctttctttctctctctctcttctctctctccttccttccttccttccttccttccttccttccttccttccttccttccttccttcttcccttcttcctttcttctctttttttcttctcgtttctttttcagacaggttctcactctgttgcccaggttggacagcagtgatgcaaccacagctcactgcagcctccaccttctggtcttaggtgatcctcccacctcaacctcccaagtagctgggactacaggcgtgtaccaccatgccttgctaatttttgtatttttttttgtagaaacaaggtttttgccatgttgcccagcccaggctgggcaatctacctgcttgaggtgagctcaagcaatccacccactttggcttcccacagcgccgcctggccataccttgatttctgttacaggaagagaaacctaatgtcaccatcctgcttctagttttttccttctccagctgattctccacactgttgcatgtttctctaaaatgcagatctgatcatctcaccccaaccccactcccatataaaaacacttctgtgatttctttcatctgtagattaaagacaacctcctttgcatggatcatctaagaaccttctcatatggtcttagactaattttccaggaccttgtgctccagtaatgacttggcattttccccaaaagtcccatgtcatgttgtgactcatgcctttgcacatgctgttttgtgctcctctgcgcccttccttcctctgaactggctagagaaccactctccattcttacataggaccttctccaccacaccctcccacagccttctagtcacggtaaccaacccttccactaaaatgccttggtattatgttcatctaacagttactgattgacacttaaggggtgttttctatgtattaggcaccatagtgtactcttttgcatatattatatttcatttaatcttctacgaatgctatatggtactttcatggctgtttacataagaagaaataggcttatccatagtcacacagctacttggtacctgagtcaggacctgtacaaggtcttccttacccgagagcctccgcttgtacttcattatcagatactattataactattgatttgcacactgctttctcctattagactgtgggttccctgagagtaagttctatgttgaaccggagatcaacgttatttcaaaagtatataagattaaataattattcttttgaagtttgagaccattacatggactgtttttgccaatgtaaagacatttttgctaacctattatgtaggctggagtttgcatgaagcagatcatatacaaccacgtagacctgggctcacttcatcggcatttcatctgctctaggtgagatggagaaacggcagccagttagtagttcattttccatctttcaagagagattgacatctatattttttttacacagcagataaactggtaatgaatatatatatgtgtgtgtgtgtgtgtatatatatgtttatttatttattaaaaaattttttttgagatagggtctcactctgtcacccaggctagagtgcagtgacgcaatcatggctcactgcagcctcaacttcatgggctcaggtgatcctcccacctcggcctcctgagtagctgggaccacaggtgggcaccaccacgcctgactaagttctgtattttttgtagagactgggttttaccatgttgcccagcctggtggtaatgaatattaacttggcttggtccacttagacatacatgaaaggacaatttctgttagaaacacttacataagaatatgaaaaagataagtacactgttactgacttagataaaaccagtgcaaccttaagaaacagtactgggagagcaatagtcatgttagattgagcaagaggctgcatcttctaatctttttttcatgattattttcactagtgtgctctttcaggaatgtctctgtgcattctttataaaactgttgcccagatctttttttaaatcacatcaaaccaaaaaaggtcaaataaagagcaggaagattttgttctttccgttgaaggcatttctttaatattaaaaatgtactgaaatgtagaaatcatattctgatgatgtctgaaaagaattcatggtaaagagtaaaaagacaaagaaaaaagctctcaacaatcactggtggctgagggccgcagtatcctcattgggccagcttttttctttacttcaaatggcagaaaaaattcacgatttacaattagaaaaaaaatcctaaacgtgtgtggatattacgatgaatgccactcttcatgtttattggcccacatggtaaaacacattatggtgaaaattccaacttcatctataagtgaaaacaaacagaaagggcatcttttcttattcaaatagagttccagagggtgtgtttttgctttatttccaaccataagaggctcctatctgaaggatctttctgtgtagcttgagtgcccaagttggcaacttaggtctctataacaatttcattccctctctttatcttgaacacgtatttaaaactgatgttggcagcagaaaggctaagattttagggataagggtactattttatcttgtatgatgttaacttttttcatccagctttgagaaaattctttttttctccttcattttgatgaactgaattaatcttgcttctttatgtccttaggaagctttaaaatactaagacaggtgaaaccaagtccctgtactaaaggtggcttatgtgatctttgtcatatccagtaatcttctgtgatctttgtcatatccagtaattttggaaataaaagggttgttgtattgtaaacttaggttaatatatactttaaatgtcccttatggcaaagtagatgtttgatggaatgagaactttcaggagacttgcctgagatttttttagtctacacatggtatagctcaacttagtttgtggatcacatatggcaaccataagaagtctgagagaaaaaggggggcggccagtagaaggtaggagctccctatatttcttaaactattctgagccaattggatggtagagactggtgggtagttaggtgagaaagtgctaggatggtggagctgcctaggaaacccagcctgcaacccagcacagaactagacatctgcattttatgccagcttcctcctttgcctccctgaacaatgctgaatgcctaagagttgaccagaagtagcctctgttctgtgcagaacacaaaggaggaatcaaaccctgtcttcaaggaagtaacagttttggggggaagcaaaattaacctataaacataatacaaggccgaggcgggcagatcacgaggtcaggagatcgggaccatcttggctaacacggtgaaaccctgtttctaccaaaaatacaaaaacttagccaggcgtggtggcgtgcgcctgtagtcccagctactcggcaggctgaggcaggagaatggcctgaacccgggaggcggagcttgcagtgagccgagatcgtgctactgcactccagcctgggcgacagagcaagactctgtctcaaaaaaataaataaataaaaaataaaataaacattatacatccagctacagggaaactcagtataacagacatttggggaaagaaaaagatctttggccatggcattgcttgggaaggtctgtgggaggtgagttttgagctgtgctcccaaagctgagtagcagctgaacaggcagaagtttggcaaaaggaaattccaggtgaaggaaaaaccatgagccaaggcgaaaatgagtgtggctggtgtgagagctgagcacccacacttggctgagggcttgacaggagatgcttgggaatgcttagaaataatattggatagtccattaattaagttttaagagaacttaaaagtctggcagagagatccaataagtgagtgtgaggcagttgtttttctgagcaggggaataacatgatgacaatggtattttaggaagattgcccagatgtgacgcagctaggaagagaccattttgtccaaatccaaggtgattaagagtcaaagatgtccatggggagaacggagatgatgaatacaactaaagtgacattttggaggtagaaataacatgacttggtgatgaaatagttataagatgtgaccgatgcagcaggtagagcccaagacaatgaatgccaaggtttccagcagtcttcctctcaatcctgataacaccatcaaggacacagcatccccactgaactatctctgttacctttggtttcctggtttccacttgtcttagtcagctcaggctgctataacaaaacactgtggattgggtggcttaaacaacaaacatttattcctcatagttctagaggctgggaaatccaagatcagggtaccagcatggtctggtttaggtgagggctctcctcctgacttgcagatggctgcctccttactgtatcctcacatggcagagacagtgcaatatttctcctatgtctctttttgtaagggcaataatctcaccatgaaggccctactctcatgacctaattaccttccaaaggccccatctccgataccatcacactggtgctcagagcttcaatattttggcggggtgagaggcattaacattcagcccataacaccacctcaattttaatgccttttatttccacaccagagatttttttcacccccactttgctgtgtcactggcctcctttccattggcaagcctagccctacaccaaactgctgagacaatgcaggtcaggacaggaggtacattaagagcctcagtccatcagctgcagacaactgaattcttcttgctattgcagacccagtatcaggggcctcaaggccaactcaagggtgtgcttcattaacccaggtcatatgcatgggtttctgccattccctcctgcctactgctctaggtctctgctagaattagagcacagggcagatgaaagacaagcctaggatactgcgcgaggttctgtggaacagaactttctcttttcttctgatatgagcctggaaacataggctcaggaactgatagcaggtatcttgcaaccatgaaaaggacaatttgtggagaatggagccaacaataagggaacagagttaaaaaatggagagagaataattggcttttggtcacataatttgagctattggattaagcctcccctgaagccaatgctacttctcagttgacatgaagcaacatattcttcttattggttaagccatttgttcttcaaccaattatttctaataaattatttgactggggctgagattccctgccaaggacctagactttgtaccctatgagctggccccagcagtcccccagcaaggtagtaagggccactcgatttaaactctgccacaccctactggctggactggattgctttgggtactgacacctgccccagctcccaaaccaacttccacatctccaaataccttgcctacctcactgttcatctgcatttcaactctgatcactcaaaacttgcctactttctgaattaatgagttagtttccttgtgtagtctcttggtgacttaacctacaatttatacacaaaatcatatgttgccaggttttttgggccaaatccgaactctgggagctccctgacacctgcatgctttatccccaggctaccgcctgttgctacagaaagtaaacaacaataataaaacacacacatgctgtttcaacagggtcatctagaaattcatgctatttaacctcaatggaccttctccattgctggtcaacctttaactgctctctgttttacatagtgtaggggcctttttcatacaatgtctacctcatgggacacccacatacttagtagccaacattactgacgatctgctgatgactgaccctggtgtaatctagggttcattggtcccttgtgctgggtgaagcctttggtaatacttagggagcaccagagaaaataactttacacaaagacaaaaagtttagttatttgctgtatgtcttaattgatgcaagccatcaaagtaggaattgcagagaacaaggtataaatcaataaaataagtaaatggaagtgattgaaggacagagccactttaaagcaagtgtcgctcaatttcctgaaaacataacgaaattgctttgcaaaagaaatcataatggtttgcttttaatttttcctaaagagcactaataacaaataatggaaagttcaattgataattaaagaaaaaaaaaacacttcacttttgagcattcatgaggcagtattcttttcaaattattatactctggcaaggcatactcaaggtacttggttcctttgtactctttccctctgtatttcaggttttatatgaatgaaacacaatgagtaattccttctctttggatccttcaggatattatttaaacactggcatctggtctaagggaaacttaatgctaagtcagaggagtatttgaaaaatagtttacatctggttttgtactacccatccctggaagtatgcagggagggtggaggaaatgagcacattgctggctctctgggctgtggtgctggtggggctgggtcttttggtgtaatgcataccacagcattcccttttataaagtgagggattagtgccaccttctttgtagcaatgtcgtgacctctataatgcttcttaaattgaggacaatgatggacccaccaagccttaacacatgatttaaatctgatctgacagtacttaaacccagaactccagagggctaatggttgaacaagcttgggagaatgtccagggaacaaaatgtagaagcccgatgaattacggaggaatcacaactccagggcaatggaggggggagtaaaatgacatattctgagttggtatcttttataggattgactaaaactgtggtcccactataatgtgctagaaagcaaaaaaatatatattattttcactcgtacatctataatttaagaaggatatgagttttaacaacatttgtactcttacacacacacacacacacacacacacaaaacctatcgagaggaatctctcatagaggctaaaaattagaagcaataatattttagggtggtcattaattttaggtacaggtatatagtattttaaatttctcacatttagacaaacttagaaacctgattaaaatcagtttgtgatatttgtatactgaggataaacgtaacttgtagaaccatgaagagcaaaacactcaataatgagtcacagcaggacccatggaagctcacctagcagtgacgtctgacctgcagcagccactgtgctcagagggaggccgacgactgcgccactcccttgggcactttttttttttttttcgagactgagtctcgctgtgtcacccaggatggagtgcagtggcgcagtctccactcactgcaacctcagcctcccagattcaagtgattctcctggttcagcctcccaagtagctgggattacaagtgcccaccaccatgcctggataattttcgtatttttagtagagatggttttcgccatgttggccaggctggtctcgaactcctgacctcaagtgatccgcccacctcagcctctcaaagtgctgggattccaggcatgagccactgcgcccggcctccttgggcactattcttaggggacctactccatttcaataaactataagttggtgacagggccaatgtttattttgtttttggcttgtaaacaattcacacatcgaaaacatctctgccctgctccttcactaatccccagggccctccaggtatgtcaagctgttcaatatacacgttaagcctttggcattaagtcaggaactttctacccacatccaagagaccttattacccctgtgacttgtatttctgcatttttcttttcctaactcagatcccccacctggaagatcttctgtttgtagttaagtactaaaagtctatataattcataaccgcgagggcagagaaaactctaaaaccacctgcctgtatgtggctttcgggaagcaacattcctgtgatcacacaagctgaaaaggaataaaagtgctctctcacaacagcaccaagttgaggtactttcccttctttcctgggatggaacaagaagtgtttcctttcttttccatgtttgttagaatttggatggtttctattctctcaactcagtgttactgattggctggaagagttcattccacccttttagccaaagtcacttttgaacaggctgttttcgactgccaggcaagcaccacacaaaattggcatgagatgcttttctttggttccattggcctctcctttctctctccatcactccacttacagaatcttgccctccccatctaatgccccatattgtcacattttctcccagctaactttcttttggtaaaatctctaatgtgtgacaatttcaacgggtaacttgcattagaaagcctctgattgtcaagtaaagttctagtctcgcagtgaatttttttggcccccatcagttcagttttcggcaggtgggcaggggaaacattttgggagagcggcagctggcccttctctcctcactgaaatcacactaccagtttgacttcgcctggtgttaagattaattcttttactactgcctattactgactcatttctctttccttttgaaaatatgttatgacatcgagccccaaattcaagtataaaactagatttggtggcaagaaattctcttctaaggaatagttttagactttagagtctgatgagccagactgagaagcatgtgttaccacaggggtataaacgtagggttggagtttgaaaaagggtatgtatagcctggcgataacaatttgagaatcaccacaataaatgagacctgaagacaatggggatagatgatatcattgagggagagagaatgtatagctgggaaagaagtagggaatagataccagaaaacagagattatttactgtatggggaaggcctaaaatcagaagacaatagaagagattgagaagctgctgtctaaaaaagaagaaaaggccgggtacggtggctcatgcctgtaatcccagcactttggggggccaaggcgggtggatcacgaggtcaggagatcgagaccatcctggctaacacggtgaaaccctgtctctactaaaaatacaaaaaattatccaggcatggtggagggcacctgtagtcccagctactcaggaggctgaggcagaagaatggcgtgaacccgggaggcggaggttgcggtgagccgagatcgcgccactgcactccagcctgggcgacagagcgagacttcgtcttgaaaaaaaaaaaaaaaaagagagaaaaatagaattatgctggggtaagaagtcaatgcaaattaaccttgggaatctcttctacttggctatgagctccttcaggaaaaagactctcttatttatcttacagtcgaaggctaatggctcctggcacatagtaggtgctgaataaatgtttgctgaataagtgccttctctttttaaaaataacctgtttgtcccttcagtggggcatatgttctttgaggtttttttgtttttgttgttgttgttgttttttttttaactgatgcttaaaagagggtctgaaacttttgtgttctgtcattttcaaaataccctctaattataccctaatagttatataggtatcatagctagaatttcccaacaggcaggatttcaactcactgtttgggtcctgttactttctgtatatttttataactcagttgtaactaaaaaaaaaaaccctcataattgaaattctcaagaacttttctatttactggcagtatattaatatacacaaatgcaaacacatttattattctttgtcccctatttaaaaactgaataacaacaagtgtcaacttttaaaacccatcatgcattcttcaggcttcaccttaaccccaccttcctctagacttagaagctccaaaatatcacagctcacagagaaatagagcctgcaacaattaaccaacttaattttcacagatgctaccatcaatcaatacatattacatattaattttcacatatgctacaatcagtttttcacaagcttcactaaaaaggtcagtatacaccgaaccaaaaatttagcagttttaaggattaatgaaaactaagtagatactacttcagaattatgaatctgattgtcagccaactcagggtctaaaaccttatggaatgtattactactgtatttactgatcatgcagttgaatgcctgctttgtacaaagcactgtggtagtgggcggggggggcggggcagaccaagactaagctcagtacagataactggggaatcaactcacactacagtcgttgaaaaaataacccattattataaagaaatgcatcaaaacaacataatagattatacaaagaatataaatatataaatatccactattatttctgaaaggaaacttatttctcagatgtctgttagggttgtttggctgagaaggggggtgggtaaaacaaatagtacgcagctggtggaaagagaaggactataagcaggtggcaaaagggaaaacagtagtcactgggggtcaggaatctgaaggtcataccacagggtgacatcacagaaaagagagccctgactacactttaagagctcccgaaggggaaattgggaggtagcatccataaggggagaagtacccccatgtacagggaatgctacatctcagaaaagaggatcttgcactgtgtctacgggagcccatgatgagtgtaagagaaaagggtcaaaaagtctctttgtgactgatgtacggacaagaagaatggtgtttctatcctgcatatgcaagaggacttggaggctttctgtctctcattggtacaaactccctgaaccaactggagataaactctgttcatcttctatgtggtgaaagttgactgtggaacaaacagacatactatatacaccaacacacaacatatatatgtgtgtgtatgtatatatatagtatgtatgtgtgtatgtacatatatagtatgtgtgtgtatgtatatttatagtacttgtgtgtgtatgtgtgtgtgtattcctactataatacattcactgccctcagaggaaccttagtctagtggaaatgacaaaatatgtccacaagtaattagaatgaaggtgatgtgtctgaactcaacaaaaggtagctattagaaatcctcaggaagcaaactctttcagtgaaacttaggaattctcattaaagataagaaaaaaacaaggacacatactatcactggtactacttgatatggaactggaggcctcacctgtgcaatatgacaaacattaataaataaggatgaaatacaggaaggaagatacaaacattaaatctgtttaggaatgatacaattgcctacttagaaaatttaagaaatcaactgaaagatcattagaagtaatgttggtaagagctctggtgagacaactgtaatactcctaaataccagaattatccatttagaaaaaacaagggaaacccatgaaaagaaaatataccataatatatttgggaataagtttaataagaaatgtacaacacatccatccatattaggatagatttcagttgtaatgaaaaaactaatgaaatgcaaagagatgtaaagttcctgaatgggaagactcaatatcgcaaagatgtcaattgtcctgagactaattcataaattcaatacagtccccataagacaatcagtgggattaaaaaaaaatgaactctacaatcttagcccaagattcatgtgaaggagaaaatgctgaagaataactaagacaatttagtttaaatttttaaaaagatgatgagaggagtcttctctttatagatgatatttactacatattagtactcttcagaaaggttttgcttgtaatacctgattgaatcctcacaacaaattcataaggtgagtaccactattaattcattttcaagatagggaaactgaggcaaatcaagcaagtaacttgcttaacgttccatagcaagtaagtggaagtggcagagctgagatctgaagccaggcactgtggctctgaagctcatgctcttaagtaccctaatagatggctcatattggcacaggaaatcgataaatgggaaagaagagaaagtcccagattcacacacatatcaaaaatttgatttttgaaaatgatggcatttccaaaaaatgggagaaatatatctcagtcaatacatggtattagtattaataactggctatctatttggaaaggaaactagtaaaatccctgtattagttttttatcattgctgtaacaaattacccaaagttagcagcttaaaacaacacagatttattccctcacagttttgtaggttggaagtttgagggagctcagctggatcctcagctctgggtatcacaaggtcaaaatcaaggtgtcagctggcctgggctcttatctggaggctctgggggagaattcacttctaagctcatttgggttgttggcagaattcacttccttggcactacagggctgaggttcccatttcctggctggctgtgagctgcgcgtccctctcatctccttgcgactgctattcctcatcatgttgtcctctccctctttaaagtggcaatggcgcaatggttcttaggcttcaaatctctctagcccccccgccctcttttgccacatttgccatgttctcctgcctccagctgcagaaagttctcggcccttagtggtcatgtgtctggatcagccccaccacttggataatctgggatcatctgccttttttaaggttacttattagtaaccttgattatatctgcaaaatctcttgcaatgcaatgtgcatagtcacagatgccagggactggggtatggacctccttcaggggccattctgtctaccccaatccttctcccacataatatatcccacataacataacaaatttgaggtagattaaagagttaaatgtatgaaacgaaactctcaaaagtataagaaaataaaagagaatatatttcataatctaggttagagagtaccttcctaagcaagcttggaaaccatagggaaaaagatagaaggtaatcttctcaaaaaattaaaatattgaataaaaaattaaaagataagcaattctgaattctgagaaagtatttgcaacttatctaactaacaaatgattaacatacagactatgtaaaaaataaactttcttttttttggagttggagtgtcactccatcacccaagctggagtatagtggcacaatcttggctcactgcaacctccacctcctgggttcaagccattctcctgcctcagtctcccgagtagctgggattacaggcgtgcgccaccaagcccagctaatttttatatttttagtagagacagggtttcaccatgttagtcaggttggtctcctgacctcaggcaatccgctcgcctcagcctcccaaagtgctgggattacagatgtgagccaccatgcccaaccaaaaaataaacttctatagatcaaattagaaaaacaaatcaatagaaacaattagcaataaatgtgatcaagcaattcatggaaatgcaaatactttccactcttagtaatgaatgattagataatccattcccaggtctgtttcaaaatgttaggcaaggcagggaagaattatggggtcaagatcctggagatgacataaagcagaagaatttgtaaagctggcatgtggggacatttttacatggtggcctttgccaattctagagtggttggtgagaggctgagaagctgaacaaatctttcttttaacagtttcacacacaaaaaatccaaagagacaaaaattgcagtccagggctcactcaggaggagtgtctgataaaatccctatactttgggtggattccaaagggctacactctaggagtaggagtgaattggaaataaaccagctctctccagaactgaagtttagcttcaagtcatctcaatctttgaaaataaattaaggctattcaagattacaagtgccactacctgtctatctagaaacaaatctaagttctctggaggaaattaacatcatcctaggtcttaaaattgtttctataaattttcatataaaatatctggcactcaatcaaaaataggcagactcacaagaagcaagacaacatgccaagagaaacaaaagacaatgaaacaagatccttgtgagctccagatcatggttacgagacttagactttacaagaaccaagacataggtccaacagaataagaaaaatgattgtgaattttgatatagaataagtaatttaaaaagaactaagtagaaagtctagctctggaaaatataataagcaaaattaagaatgagtttaacagtaggttagacacagctaaggagagaattagtgagctagagactgggtaaaaataaaatatccagaataaatacagacataggaaacagggctagaaggtctaatatatacataattgtatttccagaaggaagacagagagatagagttagacagaagtaaaagtagaaaaatctaaataccgtaactactaaaaaaagtatatctataattaattacaaatcttccaacaaagaaaagtctaggcccaggtggcttcatcagtgaactccaccacctatattacaggtgttcaccaccatgtccagctaatttttgtatttttattagagatggggtttcaccatattggccaggctggtctcgaatgcctgacctcaagtgatccacccacctcggcctcccaaagtgctgggattacaggtgtgagccaccatgctcggtaccccaaatattttaaaggaagaaagactatcaacttgatacaaattcttccagaaaacagagacagaataatttgttttatgaggccagcaaactttaacaccaacatccgatgagaatattataataaaagaaaactataggccaatatccctgagaaacatagatgcaaaaatcctaaacaaaatattagtagaccaaaatccatctacaggttaaaaaaaagggataacaaatgggattaattccatgaatgcaatattattatattattaatattattatatcaataacattagaaaataaacctgtaaattttactgcattcactgaataagaaacaaaattcatatgattacttcaaaagatggagaaaaggcatttaagaaaattcaacatctacttgtgattttaaaaatggaaaatgaactcttactaagaatagaaagaaaattccttactgtgatgaaggcagtctatacaaaatcaattgtatttcagtatgtcagcaacaaactgtgagaaaatgcaatttttaaaaatgccatttaaggccaggcgcagtggttcacgtagcactgcacactctgggaagccaggggtgggcagatcacttgaggtcaggagtttgagaccagtgtggccaacatggtgaaaccccatctctactaaaaatacaaaaattagccaggtatggtagcatgtgccagctacttgggaggctgaggcaggggaatcgcttgagcccaggaggcggaggtttcagtgagccaagatcatgccactgcactccagcctgggtgaaagagtgagactctgtcttaaaagaaaaaaaaaaaaaagaagccattaaaaatagcattataatgtgttaaataaataggagcaaatcctaccacccagaagatgttaaagatatcttcatagaaaatgtaaaacagaaaaattaattaatgtttaaataaagtagagggatatactatgttcacagtaatgactggaagacattagaaattgacaaaccaagtctaaaatttatatagaaatcagaagaacctaccactgaaatgtaaacttcacaagggcaaagattttcattcggtttgttcagcaacgtatatccaggccatatagtaggtgctcagtaaatgtttggtgaattgaagtttcaaagtgtctaaagagtttacagtaagagttcacgctgagcttcattcagttaccatggcacattctgatataccatctcatttaccttcctgtttatgaaatcacacaaagcctcaaaatcttatatgctgaatggagcagttgggatcattcggtttagtttttcattctttcttcagggcattcaggcaaataaaatcttaagctgaagagtagaaaaataagataaattgctgctctggtttcaactgggggagcctggcctggagcaccaccccttggattatcaaccctaagaaacaggacaagcatctgaacatgatatctgtgcccttcccaacatggctgctacctaactgagctgagaagagccccccaaataagtttgtcagggccaagacaaacagattgcaaattccttcttattaataataaaaaactggacaatctggctgtcagcgtgctctttacctcctatttcttctcaccattttagaataaacctgtctgtaaatctcacatacaaaacctaaaaaggatctttaaactatttattttcctttattataatagaagttcctagagtataaccacattttctatgctatttgtatatactgagagctaagtacgtattaagttgctggattcaaaacaaactttgtacttaataaaatttaaatgatgccaattacattatattctttactaattcttagtttttcatttaattcaataagttacatgcatttgaacactttctaactatatattttttctactggaactatgccttctaattttgtatataaatccaacaggatatctacatggaacatacatttaaatggccttttaaacttctgaattgtctgttgcattgaaaaatcaactttctttccttgtttctagtttaaactgacgtacatctggtacctttaaaacatctctacttcggctgggtgtggtggttcacgcctgtaatcccagcactttgggaggctgaggtgggtggatcacttgaggtcaggagttcgagaccagcctggccaacagggtgaaaccaggtctctattaaaaatacaaaaattagccaggtgtggtggcacacacctgtaatctcagctactcaggaggctgaggcatgagaatagcttgaacccgggaggcagaggctgcagtgagccaagattgcgccactgcactccagcctgggagacagaacaagacctttatctccaaaaaagataaataaataaataaatctctgctttttcatttgtttgccaataaacaattgcaattgcttctacctcaaaatagccctttctcaacagaaaaagggctggactatagtaaaaaaaaggaactgcaagttaagtggcccctcggaatgtttgatacgtttttccaaacatgacaagcacaatcagtagtcatcaaacatttctctctgctgactcaaccccaccctctttttaacatcactgtgttgatctctactttctctttctacctgttcactgaattctatgaattcagtgcttagtagctgtcagaacaggaagccttgatagaatactgtgggaacataaacatatatattcctttctatcttcctgggaaactatatttgatcacccaggttaatacttgataattctattctgcttgcccaccaattttaaaaggtgggatagaacacatcttggttttaagtttcttctattttattctttaagagcctccataatttacttgtttggagtaaatcatatgtcttgatcgaaaacataatttttaataaggctaaaatgaaagccaaaactgtcttaaaaattaaacgaaaagacatgagactataccacaacattactccattctaagaatagaagatgagacccagccccaaggcaggcaaagcctggctttgaaccctccagtcccaggtcagagatctgtgtgctcctgcggccctccccgtggtcttcgtcatccgtcagtattcattgcagggacgaagagccacttcaacaatgtagaaaatgctttatggaaaaacagctgcagtgatgcagtcggtgctttgctgacacgtggatttgatatgtcagcaaagcacaggattaaaaacatgcagcaagcacatagaggatcctgcctcttctctcctcccgcagcacactcagcccagtgaggttaaaaacaaagagaatctcaagaaagcaaagatgaaacagagcacgttaacaccagaagagtgctttaagtgatcctttaaaaatggcattgcaatcattgtgtatggtttttagtgagggttttgggtacaagtgtttgacttgctttggcgctttgccaccaaaatctattagaataactgatttataagaaatattttgataagatgtgtatttaataaaaatactaatgtccttgacactgtggttcaagcttttttttttttttttttttttttttttttttttttttttttcagaaaacagaggcaagtgttcaaactgtcacggagaataacatgtggccaaaattacatgtggttctatctctcataacaagtcttagaatgatgcatcataccagctgtctgggaacaaatgtattttgttggcatgggaacaaaagaattagtctgaattttgtaattaaactgtggttattaaaattactcgaaacaaaccagaataataaccattaaacatgaaaagtcaataaaagtctttgaattacatttctgttgcaattcctgttttcataacgtgctttgggatgaaacatagctttgagttgttagtacttttaaatagacttcactgcagatgagttagccaacagcagctaagactgtgaagttttaaaatcctttatggaaaatgaaaattaaaggcttggaaatctgtagaagaccaattctttttaacaattgtcacaattattgcacaattgattttctgtctctatagcatcttcttctttaaggctgcctgtgactccatagatttgttggttacccttgatgatgactgaggtggtttaaagataagcagtgctatccactgaaagctttaagtttattgattttggttctcctaataaccatgctactcctggatagatcactgggcattgtgggaggcaaatcaactctttgggaatacaaatgatactagttgtaacggtataacaggcggaaggagctaaggagcttccagagtcgtctaatattacccgaaagctacttatactaaagggaccaagttttattctttaaaaacccagagacctaggaaggaatcagcagaatgctaagttcatctatagagaaaaatcaaggacttttttggtgtcttttctgctttggccttcttataggagagatttgaaagaaaaatctgtcttgttttagaggagagcagaaaggtgggtgccacgggcagggcactggcattttgctttctcttcatctttccctgacctgtgaatgctttttggtgctataatgtctgaggaatagctgagggcccagagaagccatgaatgatcctaccagatgaaatgaccaccccggatgaaaatgataaaagaatatctttaatatttgttttgataaaagtctagacaagaatacactgagaaaaagtcacttagaatatgtttaggaggcccaataccaagggcctgtgatcagtacccaagttcagcaacttttggaactcttcgtcctcaaagtccctgtggcctgtgatgctgctaattcttcctccctccttctctccatctgtcaccctccctctccctctttccatcccgtccttcttcctcccattaattcaccgagcaccattgggcctgatgctgggctaaacgctgggatacaaggataaacatgacacagtcccagctcaggtcccaccctcaaagtgtaccacctactgagggagtttgatggaaaaagctttaatgcggagggcggggaggtgcattttagtccgttctcacactgctataaagatactacccaagactgggtaatttataaacaaaggaggtttaattgactcacagttctgcatggctgggaggcctcagaaaacttacaatcatggcggaaggggaagcaggcaccttcttcacaaggcggcaggagacagagtgagtgagacaaaggggaagagcctcttataaaaccatcagatcttgtgagaactcactaacacaggaacagcatgggggaaactgcccgccatgatccagtcacctcccaccaggtctctccctcaacaccaggggattacaattcaagatgagatttgggtggggacacaaagtctaaccatatcagggggccacagaaagtgctgcaaaggcacagatagataaaagtgggacatcaggtgggcagggctgttttgaggataggggctccggaaagcaaaggccttacagagtgattcaattcaacaagcgctggtggatgccatgaagatgacagatcgggtccttaccctaaggggcataatgtctagtaggaaattctctttggttttcctgcctttaaattctcctggctctgctcttcctgcccattccttttcaatcctctttgcatcctcctctatcttctctggtcccttggctgtgaccctgcctaccaatctgctcatggccctcttatatccctctatgctcttctttgtcaatattatccacacattctgggcttctgctatatctgcatcaagacgactctgacatgcttaaagtcctagggctctttcttgacttctggattcagattttcatttaaatgcctccaaatgaatgtcctcctgctagcatctaggatgcaacatctaaaaaaatgatagtgtcattgtccactatataccagcttatcaatttaaaaaggcattattttcaacacattcctttcttccactctctaaatctctatattctgtgaatttttcctttttttaattttttttttttttttgagacaggatctctctctgtagcccaggctggagtacagtggtgcaatcttggctcactgcaacctctgcctccctggctcaagggatcctcctaccttagccttctgagtatctaggactacaggtgcacatcaccacacctggctaatatttttgcaattttttttttaagagacagggtttcaccatgttggccaggctggtctggaactcctgggctcaagcagcctgcttgtctcagcctcccaaagcgctgggattacaggcatgagtcaccacgccaggcctgaatttttcttttctttctttctttttttttgagatggagtctcactctgtcacacaggctggagtgcagtggtgtgatctcagctcactgcaacctctgctgcccgggttcaagcaattctcctgcctcagtctcctgagtagctgggattataggcacctgccaccgcgcccagctaatttttgtatttttagtagagacagggtttcaacatcttggtcaggctggccttgagctcctgatctcgtaatccacccgccccggcttcccaaagtgttgggattacaggcatgagccaccgcgcccagcctgaatttttgcttttaaatgcatcttcacatttaccctcttctttctaccccttttgacaatatccagctcaagccttccgtatttctcttgtgaccagtgatgtgaattttaggccataacctctgaattggtctcctttcatttcttgttcatcttccctgctggactaatctttgtaaaatataacctcagtcatctagcactccccagcaaagaaaaagtcccccattgctgacaactgctttctaacgaatgactgaactgctcagcattccatccagaattggctgctggtcctgacacacaacacagcgctcaataaagagtagacactcagtaacaaatgatccctcttccctttttttaatggatgaaatgaacaaaacgaactttctggtcttgttttcctcttcactgatatcacaccttctggccaagatgttactcaatgtcccttgaacactcggcatgttctgctcttcactctgccctctaactagaatgtccttcctctctgttaatgcccaggccagatgttcccttctccgctataaacaactataatcacacacgttgcatctctatgatgtttgatagtttttgaagtatttttacacactttatcttgttttgatgttcccaagaaccctgtgggaagatattttactaacattttactgattaggaatccattatccagaaaggttgagtggcttacccatgatcacatgattagtagtgacaaaggtggactgagaaccagcagcacttttcccactagatcacgacagtccttgaagcctcttctggtttctctccctgtgccttggtgagggtatctgggactctgcagcccacgagggaacctctttccccaccctgcaacccctaaacacacacaattaccatggagaccgtctttggtcactagtgtctctcctaaattagttgatgtgtctaggccttaaatatgaagttggttgctgcaaagctgtgatcgaaatgttaaagtgtgacttttagctattttaaaataatttatgagtcacttgtgcctgcacagtccagacctttaatgcttgcaaaaccagatgagacttacaactaaaccagctggctgcaaaaaaatactgagcagaaaaccaaagaggaccccgggggcaacccaagacagcaagacaaggtagaagccaggagccttcaagagaaggctggcagaatgctgattcctgccgaacagctttggaaggacccggctccccggagggctgcaagctcttgaaacaaccccaaattagcaagtgccacacactgcctaggcagtgggaccctaacctcttcctggttaaagatcctctccttccttcccataggatcagggaagacggaaggaaggaccagtgcttgcattctttctgcatattgtgattctgagcctccaagccatttagtaaaagaaccaacttccagctgggtgcggtggctcaggcctgtaataccagcactttggaaggccgaggcaggcagatcaccaggtcaggagctcgagaccagcctggccaatatggtgaaaccccgtctctactaaaatacaaaaattagccaggcatggtggtgggcgtctgtaatcccagctactcggaaggctgaggcaggtgaatcacttgaacccgggaagcagaggttgcagtgagccaagatagtgccactgcattcagcctaggcaacagagcgagactccatcattaaaaacaaaaacaaaaacaaaaacaaaaccaacttccattccacacctggggtctacattttatacacatcccatttactctatcagactgtaaactccttgagggcaaaatctataacttattcatcttcgtttcttctcagacctaacactgtttagcaaaatacacctgttaaaagaataaaatgttgagtaaaaaaagactgagtctcctgtgaaacactcagcattgtattttatttattagaacatctctaaagtattgtttttttctcactaatttgtttaataaaatatccttctgggaaactgagtgatcaatgtaattaaagctattcatactttcaaattttaagatagccagtttgaagcagggaattttgctctgtgtatgttaatatccacagattggtatgttagaatctgacattttttggtgtctttgttataaatacatgctttacacagtgttaagaataacaagaaaacttttagactatttattttcttccttttcttttctataatttatcaaaccaaattatctagtctcactgtgaataacgaaacattgtttgctccccattgtgaataatgaaactaagtgaattttagttttacccaaaatattttaatctgtacctgcacccgagtgacagatggcatatatccattttacgcagtgtttaacgcagtggaaaataatattctgggagtaagcagaccacttacagacctaccctgggtctgccactagtgtgttgtacattagggaagtcacatccttcctgatgactcagtttctttgcacaatgaaaaagtctgactcaagctctgatctcccttctttgatgaaattatggggttcttgctcagaataaactggaattagaaattattacctcctcctatgaataaaaataatggtgattttaaattgctgtttattgattagagaaaacatcacgtttttgtaaagctgacttagaaaatttattttctgattctattggtgttatttctcttgaatctgcccaaggagaaagttaaccctttgtgccccacaatgagcacatcttccctggggactctgtgtgctgatctgtccgcttgaggggacagaagggagagttggtggcaccaaggcatgtggtggacagcaaagatgccacccatcaagacctgatgagaagcagcttttggtttttaattaaaaacataacttttacaatgcctcattcatttcttgtttttatagaatcaaaacatagacatttttcttaaatgaaaaccagaaaccatttaaacatttttaaagcaagcaagttaaaaaaagcagcttaggattgtcttttgtaattctgccagtttcaattttgattccttaatgcaaccagtatcaggataacaatatttgcttgaaaagaaagagaagatagtcctcaggggctgtttcaaacacattttagttgttcgattggctgatgtgaggctagctactgttattgaagttgctttgatgaacagtgaaaaatacattcataatgtaacaatctcaacattttagatatccttagtaaactcatatttagcagatcctaaaaagtgtctgtgacaatagttctaatttttttttttttttttttttttgagatggtgtcttgctctgtcgcccaggctggagtgcaatggcacaatctcggctcactgcaacctccacctcccaggttcaagcgattctcctgcctcagcctcccaagtagctgggattataggcgcccgccaccacgcctggctaatttttgtatttttagtagagacaggatttcaccatgttggacaggctggtctcaaactcctaacctcaggtgatcggctttccaaagtgctggtattacaggcatgagccactgtgcccagcctaattctaattatttttgactacttgtgttagtgtcacagatttaaagggggacataggtcaaatttagataaaagattaagttaaatatggatgaatagtatttgttaaatatctattatttgttatgcagtttaattgaaacaactggctttttttttttttttttttttcagctacatcctaggaccttgtggaaagaacccaacatctcttggttacaaagattatgaaatattcagctttacccatgggtatttcctgacatttctttggtaaactgtagcctaatagaagatatcaggaattagtgtaagaaatattctaaaaagctattgtcactacaaagatgaaagtaactttgatgatcaaaaagaagtcaataaaaaaagactgaaagtagttcctgaatccttctctattgttcatttgggatttcttaatttccctactctcaatatattatggaattttctgtgtgaagttttgccatgaattaaattgatgtcaacaaaagttttaccttaagtcatattttaccacaaactagagaagccccagtcctccagggagcaccttttcctgcctttaagaagcttgtctcttcttcttcttttaattacaagcatcatctacagaggatggggctcagttgaccttcagtgacaattagacctgctgatttgacatgaacaaatccatgctcccatccgaggaggcattttcatctctttgacttggcacacgatgggcaagtgtgctgtgcttgtgtttcctttgctcgttgcttttctctgcccatggaaagtcaatggcatttgctcctctaccaggaagcaggaatacaatgtctgtttgcctgccatccttgataagtttactttctctatcattgctatccagttttttttttatttgctagatatgtaacttgaaaattgtcatggaaggagcaaaagtttggagttcagataaacctggatctgaatactcttctactactgtgtgatcttggatctactgctgtgtgatcttggatgagttaatcactctggattttggcatgctattcacaaaatgcagatgataatactgatcttacatggttattgtgaaaattaaatgaaccagtatgtgtaacatttattgtacagtgtctgtcatcttgtcagcatttgataaggtatagttattattaattttttttttttttttttttttttgagatggagtcttgctctgtctcctaggctggagcgcagtggcgtgatctcggctcactgcaacctccgcctccccagttcaagcaattctcctgcctcagcctcctgagtagctaggactataggcacctgccaccacgcccagctaatttttgtatttttaggagagacagggtttcaccatgttggccaggctggtctcgaactcctgacctcgttgatccgcccaccttggcctccctaagtgttgggattacaggtgtgagccactgcgcccggcctagttattattaattttttattctagtattattctattttgttatcctattgttgggtgtattacatagacattatataaaacgtatatgtatatatgtatatttatgcatctcatatacatgatatgtacatacatatgtgatatacatatgacacagagttcattagagagtaggaaggaattataggaaggcaagtcaattcagtaagtattaacagtcagcatctattaggtgcttactttcatcattttgtacaatcctctatcgtgggatcctgtttgtaaacatctccagagattaaagaagaaaagaaaaccttccctatcagccttacttttgtgttttcccttcccccaaattcagaataagctaatataatatgccaatattcctgtactgagttttacaaccaatgtataaacatctgtcaattcctatgactgtttctgtacataatggattggtggcacttagatcaatattagcaacgctacactcaacagctgagggcaatgcatttataaagggtttcatcaagattcatggtctctagtgatacatgttgactttttagtttaaattgtcaaaattaccactaagtgtaatttattataaccagaagagttgggtgaaaataatgctgtcatttaaaaataaaataggtcattagctattgtcacagccatactattctgggttatattacattattttgaaaagaatggaaagaaaaaggagaaaactaaaattcaaaagaaaatgtgatttatgcctctaagcaaaataatatccatttattttgaaatgatgacatagcagacactgttggctgcatactcaacactccatttcccctcctttttgttccagttttcattcttctcccagtttcatcaccagcaggtgggtcctgattattctaggctagttttgtatactcagttctttagccagggactgggtatgccaggctaagcatgtgaccttctctggccaatgacatgtaaagggagggggtagtttccaggaaagatttccttactcattaggccctagaaactggcagcccttttctgcctccgaatagtgcagatctgggcagaatgcctggcactgctgcagccatcttgaagttggttctagaatgaagccagcaccggagggagagtcatgagaatgctttacttgtggacttcttgttctgtgaggtaataaattgctttattttttatgtgaaccatgggtgggatattctgttacttgcacccaaagcatcttaactgaaacaggcaatgtgtaaacttgtttttttttttgagacggagttttgttcttgtcacccaggctggagtgcaatggtgcgatctcggctcactgcaacctctgcctcccgggttcaagtaattcccctgcctcagcctcccaagtaactgggattacaggcacctgccaccacacccagttaatttttgtatttttagtagagacagggtttcaccatgttggccaggctagtctcgaactcctaacttcaggtgatccacccacctcggcctcccaaagtgctgagattacaggtgtgagccactgcacctggctgcacacacttcttgacctagagaaagtaaacaagagagtcaaatagtaaaggagagggtacctgttcctgtgactccaattctttgtgttgtaattttttctctgcacatcgcacctgattagaacggttttctaattcatcttgtaaaacctgaaacggtataaaataaagatatcattaataattagcacacttggaaaaatagttctacaccatgaactggcactaaaaaggcctcagatctctagtttattactcttgttccaaagcattcaggcaaacaataccagacttttgtgtgtcaggccaagatgttttctgctttaagaatacctagtataaaaaattccaaagttataaaatagacaaattggcagatgtcaatcatatattaaaatgtctcatattcccagcacagaaccacaagcatgtaataaagcatatgtaataaagcataacactattgcaatgaaaatggctccctcaggacacctgcaatgtacacttacactctgaatatcattgtgacggataggaattgtaatatctgaccagcataacatttttcaaaattatattatgataatttgagtaaattatagcagccttaaaggaatttctttataaagtcagagaggatggtatggaacttgaggaacttgtaagaaatggaaagaggtgaactctttcctttgccaagtagctgtttgaaatagcattcaggttaatatgggaaatggaaaccacaaagaccaataattaccactgcatcaattactatgttaagtaaagagatgaactagaaaaagaacttgtagtttccatgtgctatttctataatgacactggattgtccattcaaacaatccaatgtaattacagaaatactacatggaaagttacagtgagcagaatgcatggggtggtaacagcaaaggtgccaaattcacaaaattcatttcatccagtcaatattagtgagttcctgctgtgtgtcaagaattacgataggtactctagacatagcaatgaaagaaaacagaccaaaaaaaaaaaaaaaaaaaaaaaaactccggtcgggcacagtggttcacatctgtgatctcagcactttcaaaggctaaggcaggaggatcacttgaaactaggaattcaagatcagcctgggcaacatagcaagatcttttctacaattttttaaaatttaattagctgggtgtgggggtgcaaacctgtggtcccagctacttaggatgctgaggcaggaggatcacttgagcccaggagtttgaagctgcagtgggctatgattgtgtcactgcactccagtctgggtgacagaatgagaccctgtctcaaaaaaaaaaaaaaaaaaaaaaatccttgcattcacatgcttagattataatggggtggaggtaggcaataagcaaacagtaagtgtattatataaccgtgatgagtgcagaagaaaaataaagcagggaaggggacattctggagtggtgtgaggaagaggggattgagattttaaatagatggtccaagaaggcccagctgggcgaagacctgaaggacaagagagagcaagtcacatgtaaatttccacaggaagagccttccaagcaatagccactgcatgtggaatgactccgagatggtatgtttgtggaagccataaggtcactgttgagagtgatcaaagcagcagcagtgaagtcaaggacataacagggttcaagtcacatcaggttacgtggagtcttgcaggtcaaaggctttagattttgcccagagatagacaggaagttgctggggggtggggagcaggtgctgctttcattgttgtctgaagagcagactgaggggcaaggcagaggcagagagcaggggagaggccactgtaacaccaggaaagggaagatggagagcggggccaggtggtagcagctgatgaaggaaggatcaggtccaggtatgaaatagagatgatggccctgaaggagtggaagcagagagaggaaaaaacaggaccccagggattctggcctgaggagctaagactgcagttggcattcacagagacagggcaggtgttgggggagaggagccggagctcagcctcagttggcttcagtttgaaatgcctattacacatccaggtggagacacgagttcagacacaatggctaaattagtgtccattaaagattcctgcaaacacaatgccagtcttttttatgtccagataaacagtggttcttaaccttttgggaggttctagactcctttgagaatctgatgaaagctatgtagttactccctagaaagagaaaaaccatagttttatgattttgcctctcactgtaggacattcatagattgcctgaagcccatctgtgaatggaccccaggctaagaactaatttaaaaagtgaaatggtctgtgaatgagcttgcatgctttagggtgtctttgatattagacttgatcataaatctacaactcaaccaggtctgagaatgagcttggaaatctctccattcttgaattgtctataattctgttgttgtgttctacttccaaaaggatgaatgcaatagttcctgtgcttgttgatgaggtagcctttcccccaccccctactttcatagctaccaacaaataggatcttatcagcttcttttattgcataattggggaaagtaatgattactgtattgggaagaatagttatctattttttttgtcaccactttttcctgctctctaatccatcctcacaccactgtcagagtgaacttcttaaacttaaatctgattatgttgttccctgactgaaatgcttaaacaacactccagccccgctgagagacagctctcactccttagcacagcatacaaggggcttcatcaactggcttggtctccagccacgctgtgccgtaggaagccttggcatgccgtgcagatgtcattatcagcaataacaacaggagctatcatccacggagtggattttatttttaacccttacgacaattttgtgcacccagtattattccatctatgttagagaggatgtaattgaggctccatgcagttaactaccttgctcaagtccatgtggttagcagtaagacactgcactggaattttttttttttttttttttttgagacggagttttgctctgtcacccaggctggagtgcagtggcacaatctcgactcattgcgacctccacctcccgggttcaagcgattctcctgcctcagcctccaagtagctgggattaaaggcatgtgccaccacacccggctaattttttatatttttagtagagacgaggtttcaccatgttagccaggatggtctcgatctcctgtccttgtgatccacccatctcagcctcccaaagtgctgggatcacaggcgtgagtcaccacgcctggcctggactggaattttaacatatttttgtaacttcaaattgaatatgtttgtgctactccatgctgcctctttcccactctgtactgattttctcttttctttgcctggaagtccctaccgcacctactctgctcaatgatgtaattgccctaatctatacaagagctaagtatggacttctctgggctttcatccatctagtgtttaagagaattaatttacatgtctgggtggcatgcaactgcagctcagggctctcctctcttcatctctgcaagcccagtgccaagccagctcaatgcctggtacacaggtgacactgaattcatgtttgtggaaggaactcataaacatttgaactctactccctaaagatatttacttcaatcatcagggcttctgactgtccttcatgtggcacatttaaccaaaggtgattatgtgtcctgagacacaaaatacacaaatatatcctccaaatgtctatatctatctctgaacacacacacacatatcataatgataataattgataatatattatctggtttctgctacaataaaaaatactcctttaattttatttcacagaagagaaagatggcatgcctctcccttctcttaaacgaagagttgttccccacttcctggcttctctccctccttgccttcacctgcagaaccctgagagtgctacactcggcgtcccacaccctgccccattcactacataccccgttacacctgccccctgtccccactgctctcctgagtcagttttcacaccagtcacttgtcatctaccaaatgccaaaaccagaagctaactttcttcctttttccacagaagcatttggccctattcacgcccaattgtgtttttctcttgaatcttgaggaaataattctgctcagtgaagtcaagggattaaaaaaaaaaaagaggatgctgcaaaagtgaaggccaaagacaacaggcctggaaagagggtgatggatatggagaaggggatgggtgaagtggaaccgttgacagggaattggaaaaaagggactcagagataccccaaggctttaagatggagtgaccagaaaatagtgaattcttgctaagcacaagtcagaagcggtggggcagtgtgctttctgacatgctgggttgaaggtgctggcgggacttcaaggaggaactattgctagactccaaatattgctagacactatccgtgccccctccaaattcgtatgttgaaatcttaacccccaaggttattaggagacaggacctctggcagggaatgtcctcaagaatgggactggtgcccttctaaaagctctgagtgaggtccctggccccttccaccatgggaggacacagtacaaagatgggtgtcaacgaactaggaatcaggcaggctctccccagaccctgaatctgctggtgctttgatcttggatgtcccagcctccagagctatgggaaataagcttttgtgtttaggagccaacctgtccaagggatattgttacagcaaccagagctcactaggacccctggctagcagatcacgttgctcagtgggtctgaacagtggggcatgctctcagacagaggtgcaaatgcggaaacttccttagggaagtttcctaaaatgagaagaggttctaaaacctgccctttgggtgatgcccacactcagacaggcagaggaggagatggaggccaagaaatctggtggaagtccagataggcaggaggcaattgaggagaagttaggatgacatattacggaaatctagccaaaagaaagttccaaagaaggcagggtaacataactagatctgatcctttttccatacttcacatagtgaacagactacgaagtcaaccatattttatcagtattattaaaatggaattcaaattacatttgcttttcaaaaaggcaggcctttaaaaatttccttataaagatgtaaagtgtgatctttctaaagttaatcagagaaagcagttgtatttagaaatgactttcgttacctattaaagatcagttaaaaaactgaaaagtcaccaaataatatttcactttcaaaaaagttaaaatgtacggcatgaaaggaaaatgacagtttatattggcagctggtcctggttttatattctaaaagattattaggttattagagttccaacctcagaatttgacataaggactatgtgaaaatgaccacaattgctcaataagtacaaccgcggactttaagttgtgtcatccttattcaaaaaagcttcaaatttgacatttcacacacacacaaaatcacaacttttagtttcttcctgagaaaagcccaagataattaaagaacagaatgtccaacactgggtcaaaaatatgaaacaaaacccaacttgaacagttaaattgtttattctgcagaactgtccctcctctcctagctctgcagtgttaactggcatcattactgaaaagacagttcttttctcccaattaaatctgcctttaaatatactgtaagtcagctggctgtgggaagctacaccgctcctgactttcagagtgctttctgctggtcgggaataaagaatgacactttccagaagaaaaatgtaaacgacataagcagctccacaagaacaatgagcgcacaccgcactctttaaaagggagagcattgtaggataatttgatttgttccaaatctgaaaataatgagagcaaattaaagtgtcaaaaattgaacatgttaatgggctcttcagggtgaggaaaaggacctggtagctaacatgcccattgaatggcacttgtgacagtacagggcttttctgtgagtttggggaaaaaagagtatctagtcaatgctattttaataatatgtatgaacataattcagctcaagccactccttaacttgtaaaaccacacattaaggaattatgtatagtcttaccaaagttttctcttgtagttctgcgtcaattaaacaagaataaagtgatggcagatacatgccttttaataatgaataaatgaaacacaagttcatttcaattataaagtggttaaaaggttttttaataaaggaaaactttattggaagagagaaatactaggtcacaatgataaaaacaattttttaaaaaatgttcccagaatacaaggtatataacagagagaggctttcagatgtagtactgtagcaagaccggacgtctttctagagatttctgctctcgcctttggcccacttcttagccagctccattccagcaacccaagagctgctaccttagtacccttttcccaacaggctgtctaagcgtataaattggtcttcagcttatagctcagaatattggtactctaagttcgtactagagaatacaatttcaaactctactttcccgtctttatcaaaactccatttatgagacatctggaaaaatccacttgcaaatcaagacagaatcatcagcagtataaaagtcacccttctgagtcagtggtcctggaaacactgtcctagcagagtggactgcagagacacattctcttacacattttctgtcatgcagcttgtagagtcgcattcttgcccccttttagagagtttcaaagcagttctcattgagttgaaatttaatgtgtttgacacatattctgcctcattctatgttgttacgtcttggtaaaatgctaatagtgcctggccttttcacaaatcatcatgaggtctctgagcacgtttttctgggcctgccctgcatgatggggcagagtgtaaatggatcttgtccttggttctgtccgtaggttcacccacatgtcctttgggaagtgggaaccttgaatgctatagtgttctgttatttaaaataaactggattgaatcatatgtaagcaaaaagagtgttgattaaagttttgccctatataaatacaaaactggggtcggtagagttgtggattttaagggccttgggtacagtctgtggccgtgaaacaaggaaccagatgaacctccgctgggtgaaacgcagaaaggggacttgcgagctgcaagctctgcaaaactgagttttaacaataagaaaaagccagagtatttatactgaagatgctgccaagaagaagtcaccctggcaaactgcgggcaactgcttgaagcggggtgatgggtagatggcggatctgtgtactcttctccctacttttgtgtatgtttaaaagcttccgtaataaaaagtcaaaacattgaaaaaagaaaaaaagtcccacttaaaaaaaaatgaggtcatcatatcctttccttcacgaggcttgaatttactatcctactttggagaaaacagatgattcatttgccactcagtggggaggagggatgcgggaggatttaccccatgaatgttttgaacacagaatgaagagaccaggggggtaggatgtgcatattttgactaaaggagaagataactagaagaggaaggcctatttttatttttattgaggtataatttacatacaatccaattcaatgtttattttttcatggtaatggtctgttttccatttaaaacatgtaagatgatttttaaatgtgtgtcatcaaatatttgttaagttataaaatcttgacgtaaacctctcttcccctggctgcttggtccttcagacagacgtgatgcctgagctgtgactacagtgaagagacactaattataaaggtgaaataagggtgactctcatttaaaccttaattgccttcttaataatgcccacatttgtttaagcagcattactccaattcagtctattaactgggctgataatatttctgatgagtaggtctccttttgccatgtaaattgacaccgaaacagtaaatgtttttctttctactactgctaaatgaaggctaaggtaaaatacaaataaagcagtaaaatctcactctattttcatgtgagatttacagacttattttttttttaatcatattgtaaacgactaggacaaagcaagaggatcaagccctgtcatccacacaaggagcgataaatgtggggctaccgaaagtgacacagtggcagcgtgacatttttactgggtggtctcacgggctatttacagaggccactatagtttctgttttattatcatttttaaataggctaaatctactaacaaaagtaactagtcttcttcaactgaaatgccactcaagatttcttttaaagcgatttcttcattcagacctacccaggatgaataacaaaccataaaaaaagttttattagtgattctacagtcatggaaaacaggttatgctgcagatctaaagccagagccgcagctactactgcagaggccactaatgcattcacaacgcaactgtataattattttcccctatggcttatgttcaggttttcagttttttttcacatccaagcaacacttattttttgttcaggttttcagttttttttcacattcccagcaacacttatttttttttcttaaaaaaacaaaacaaaacaaaaaaccctgataattctgtctcttttgtgatactgatgtgaaggtttttacccaatacatatgttactcttcacataaggcaaaattccttccacgtgaaaactttttagttgttgctgcgacaaaccacatgcatgagaaactgcactttcatatgagctattgctatagtacttattaggctactgattcaacatcaaaggcaaaaatactgtggccactatataaagcaagagtttttcttgtttgttattctccaagtacgaaagttttcactttttctctttccttctctcgctcacctattttcagtcctttaaaattcctaaaggacttcctttaaaggtcttaaaaatgcactttttaaaaagttaatgtttcctggtcttaacagaggttccaggaaaagaaatcatgttatttcaagactttgatgatctaaggaagccggaatctcctaacgcacctcattcatgttttcctagtcacacaaaagaccatcctgacattacccgcagctcctcttaaaggggccagtctatttctactcaggaaattcaaagcacattcccccgcttcgtggctctaaacagcttcacttgtgaacaagttcttatctcgggtggtagaaatctaggatcaaattcaagaaccacagctaggattttgcaagatcatagaggaatttcctcgtctggccaggatgataagcactcaaacttgagttcagtctctgtggaacagagtgttaactgttaaatcctcacagaccacccctcttcagtgcaagcccagggaagagggaggacccataagccattcatttaaatttcgattttcttacaaagactaattcacacatgccgtcccctgaacctgcagtatcatttccaatcccctccaccaaactgtgtatttctcctccgtgaaaactgaagattcatttcttccatgaaatatttcaaatacagattaaactatttcgcattgttattatattccctatatgataacatatttatagatctcttcctattgtgaatttatctaacttcttttctcattttaggctctgaacttcaccagagcagcggcctttgcccctccattatttgttaagtggtctctgaaatgcttggcaaagtgttatttacactacggtaatgagcatttactggtaacattaaccaactctataaagagcaagttgcctttcatttaaaacagttggggtactcccattaaaattctcagatttttttttcccccttaagctatatttcctctcattctgtccctagagaaaaataactgagttttacccagtctgctccctcgagtgtcagaagtggcctcccttcttgttttttaataataacacatctatcagtgcccttttttcacgatctagagggctggtcaccactgttgctctctcccttttgctaagtcccttctcagtgtctacactggcacgttgtctttacccgtttgcccttcaagaaattggccacatttcttttgtttgtttgtttgaagagatgggggtctcactatgttgcccaggccggagtgcagtgactcacaggcatgatcatagcaccctatagcctggaactcctgggctcaagtcatcttcctacatcagcctcccaagaagctggaactacagaggcgcaccactgcacctggctgtttttgttggccacatttctcaagtgtttgactccagtacccttatttctcccccattagtgaactccttcctcatcagtgatctgattttggtttctaaccagttatgagacttgttctctgcaaggtcagcgatgattctcttactgatgatccagtggccttttccacaactctattctcctggacctctctgttgcaccgggcactattagaacactctacttccagaaatccttccctttgacaccaccatgtcatgctgtcctcctcctccttcccacatgctttctgctcctcctcctcttcctcctcctcctcctcctcctcttctctctcacttgcggatatttccctaactaggttcttacctctctagccttctttctatacactgtgtccttcagatcattacttccgtaagttaatggaagtatttctataatctgggcatatcgcatgtaccagacgtggtactaaacattaccctcaaaaagcatctaatctaatgtgtacggcaagcttataaaggaactattacaataccacatgagcactgctaaaaagaagtcttaccaagcattgtgactgaacacaggaggaaagcaacaaacgccagggaaagtttagacagtgagaacttcctcaaggaggtaatgtgggagctggagggtttcccaggaggagaggagagtggtcctggggagtgaatcacagagggaaaggcatggtggcatagacctgcaatgcttgttggctacaccgaaggcatggccaagcagaggggtggcactgaagcaggagaggctacatgggttgcggctcaaacttatcaagtccaagactaaactcaagggtcttgtgtgccaggaggactatagattttaccctgtaggaatgggaaccacaaaagggcctaagatgatcagatttccaatacaggatgaacattcaggtgacagtgtggaaaatggtggcagggaggcctgctggggacagttaacagagtcttggcaagacatgggtgaatctatgggacaagacagaggcaaggatcagattccactcagccctctcagcatataggagaaaaccaggcccagaaaaatacacctgtaagcttcacgatcatttgtaaaaagtccaggaatacagaatgaggcttaggacattaaattttcggtcaatgagaaatgctttagaaactctaaaaatgaaaagaataaaaaagcacaattttacagactgtgtaaccaaacatgcaagaaaatctgtctcaggagttcactctgccatggctgggaggccattaggaggccatgtagtatcacgtgggagatgagcttgatttggacaagagatggcgagaaatgatgggcccgggggaatgcatgtgccgggatggcagcagagccacaagacaggttgcagggcttggtcatgcaacgaatgtgccaggtgcaagaaggaagtttaaagaatgactctgaggctttcagaataggtggctagggtgctgtcattaactaagacagagaacacagtagaattaaaatatacagaaaggaaggggaagaataagtttctgcatgacacggattcaacaggaatgatgatgccaatggcttgaccattagagtatggtgtcaaaaaagaaatcatggaaggaacagttttggggaagtaagatcatgagttccattttaaagtcactgagtttgaatgcatatcacgacatccagctctcctgcctgatatgggcaacagaaacactagctctaactagggcttgcctagtgacgactcctatactcatctccatacccaggatcgcacaaatcctctaatctgacatctccaactgtctctcttatgtgtgtatatggtggccttaccatcatctcaaacttccaagtccaagactaaactcataattttccccctcaaccagcttcccttccacctgtcctgctgatcaatgacaaagtcattcattcaattaccaagttcctggttttaaatctcacaatcatttgtaagccctactctctctgttctccctcctagttagttgcccacattccttcaacttctttttttttttgttttttttttttttttttgagacggagtcttgctctgttgcccaggctgtcactgcaacctctgcctcctggcttcaagcaattctcctgcctcagcctcctgagtagctgggattgtaggcacccgccatcacacctggctagtttttatatttttagtagagatggagttttgccatgttggccaggctggtgttgaactcctgacctcaggtgatctgcccgcctcggcctcccaaaatgctgggattacaggcatgagccactgcgcctggcctaacttctatttgaaatgactccactctacgtcctgatttctgcccaccaggattccagactctttcccagttgtgtcctcctgcatcctggcatgtaggatgtgttaagattagcatcctgcaccctgcatccttatcctgtcaaggttaaaatttcttccctggctctgaatcccttcctaaactagcttcatgtatctatctggacttctttcttactgtgctcaatatacaggaatccccatttatctgtggttttattttccacagtttcagttacccatggtcaactgtggtccaaaaagaggtgagtacaaatacagacaagaatatatattgtgagagaggaaagaaagagagagaaagaccacataatttttatcacagtatattgttgtaattgttctattttattattgttggtagtctcttatagtgcctaatttatatattaaacttcataataaatgtattagtccattctcatgctgctaataaagacatacccgagactgggtaatttataaaggaaagaggtttaatggactcacagttccacatggctggggaggcctcataatcatggcggaaggtgaatgaggagcaaaggcacgtcttacatggaggcaggcaaagagacagaatgtgtaagggaactgccctttataaaaccatcagatcttgtgagacttattcactgtcacaagaacagaatgggaaaaactcgcccccatgattcagttaacccccttccagtccctcccatgacacgtggggattattacaattcaaggtgagatctgggtggggacacagagccaaatcatatcaataagtatgtatatacaggaaaaacatatgatacatcaggttcattgctatctgtagtttcaagcaaccactgggatcttggaatggaacccctgtgcataagaggggattggtgtcctaactcaaagctgtcatgctaggtccaatatgcaggcactgtgctgtggctgtaacagctttactgactttcacaatgtccctctgaggtagaaacctcaccttataagaaagagtgaagggccagccacagtggctcacactttgggaggctgaggcgggtggatcatgaggtcaagagttcaagaccagcttggccaacgtggtgaaaccctgtctctactaaaactacaaaaattagccaggcatggttgcaggtgcctataatcccagctacttgggaggctgagacaggagaattgcttgaacctgggaggtgaaggttgcagtgagtcgagattgtgccactgcactccagaatgggcaacagagtgagactccatctcaaaaaaaagaaggaaaaaaaaaaaaaaaagctaaggttcctagaggctactcaaggctacccagctgcgaagtcttgcagacaggaaatggcccaggtccctctgcctctcagcctctacgttttgccaccaatgggcccagctccacacattgccctgtgagctctgtgggtcttatcttcatcatatctagaatgccattctcctgctattacttccatccttcaaaagccttctttgtccccaaatgctctggatttactattaagatatttagtctttaatctaacaaattaaaatgtacaaaaaaaaaaacccagaaaaacaagtttttgtgtcacagattcaacagtcataatgattccgaaggcttccctattagaatgtggagccaaaacgacagggtattacacaaagtgatgagttgaattatatcctccagagagacatgttgaagtcctaatccccagtacctcagaacgtggccttatttggaaataggatccttgcagacataatcagacgaggtcaccctggagtagagtgggctcttaatccagtatgacggacgtcctcacaacaagagacgcacaggaagaggttggccctgcgacgacagggccacagatgggagtgatcatctagaagccatggacaccaaggattgctgggaaacatcagaagctgaaagagacaaggaaggattcctccctagagccttctgagggagcacagccctgcccacaccttgacttcggacttgtggcctctagaactgtgagataatagcttctcgttgtttcaacccacccagtttttggttctttgttacagcagcactaggaaacaaatacacatgggaagaaacgtcccttgttttccacattttctcttgtaaaacgtgtaaaatacacacacacacacacacacacacacacacacacaaacatttctttcaactacccagtcctactagacctcattttacccatgtgagggccaacagtccaatcattatgagacaatccggaaaatggcattagggtattactatgttatattgatctatcggtattttcttaattttgtgtgtgtacatggtcgtatcagatcattaaggaagccactccaatagaatagatggctccttcttagctgatgaaagagatactgcttgaggtgcagaggtggagatcctcaggtgagcctgcctctcacacctcacattcacatgacggatagaaatcattcacgccagataaaatgtttttctttttttaaccttaggattctgtgatatctggagccaatactcatgaaggaagaagtttaaaactttccgtttaaaccacttagaatgagaggatttacaaagatcctgtttaatgttcagctgacacattgtcaaaaacgtttatcatgcaaccttttgaagtttcttccactccctcctagttattaaagcttggattgcagttagttatcaacaacaaagcatacacgtgatggtgtttttagagtcagcctttcagtttgatttctgaactactaagcaaaattcagttctcctgatcagaaaaatgattagtgacctacttttcatgctgaatgcacaaaaccgttgatttctgaaatcacttctatatggacctagggataatgcaagggacatggaaatttcatttgtatcataatgctccaaactgcaagaattttcagatataagaatctgccacttcaagtgaggctgtgattctttcagtgcaaatgaggaaatagtgacctacattattgagaagattcctctggcaacttaattcctaatgtaaatttcttcagattgagaataagcttcagttcgtgttttggcaaggggaataaaactctttctgaataattcaagcgaatactattttttgagtctgtacaatgtattagaaggtacagagttgggtaagacatagtctcaccttttacggcacttacattatcatagaaagtatgtgataaggacaaaaagcaggagagcatggtaagtgtgttaagtgttcaattgagagaacaaaaagaaaaaggaaggacagaggaagatgttcaatgacaccacaaggaagcaggcagataaatccagaatgtgggacattctacaggacaactgacttggtttctgcaagaagtcaatgacatgggaaaaaagtgaggaagggtctgctttagatttgaaaagacatgagagctgtaacaatcaaatgtaatgtttggatcctgattcagacaaatcaactgtaaaatggcattttaaagttaatttgggatacttagttatgaagtaaatattagatgatactaaaagataattgttcactgtcttaggtatgacaatggcactgtgtctgtgtaagacaatgcccatggtttctgagaggcattctgaaatacacagtgtaaaacgacttgatgtctggaatttgctttaaaatattttagcaaagaatgagggggaaatgacagagtaaatgtgaccaaatcttgatagttactgaaggtgggtgacaagcacacaggagttcatagtactattatctctacttttgggtatgtttgaaaattttcataataaaactaaaaaagaaacaaacattttatgtacagtaaaatgatataagaaaaacacaaagagactgggaacgtcttcaggaaggacgcagtatttgggaaaagccttgaataatagctacagttctgacaggcctaaggtggaaaggggaaagaattgtctgccaaagaagttgcatttgcaaaagtaaatacaaggaaaatgggggtgtgctcaggacaccctggtgcagtccctggagcaggacctggaatatgtgaaggggaggcagacctgaaaagaggaggccagagcacagtgaacttcagagcacaggctttagttacacttaacttggtgaaaaggagaggggcttttgtgcaatgcctaaaatcaagaaagatacacacagttacttcctagacatttacaacatgcgtcccaggcttaacaggttcaaaactggacgtattatcagttttcccactttatttccctctccttccactcacccctttgcctcaatctaattatgttcctatatattcagatctagattaacggaacccatattcacctagttatccaaatcaggaactgcgaggacacccttgaattttctctgccatctaaccatttaccggccttccaaatatttctcctcttcagccctatggctattgcccttgtctcttttcctctggatgatgactacactcatagatctcttcgttccaattcattattgccagagcaatattccgcatcatcttcaagtttctctatctcactgcacagtaccactaccacccacatgatctatcacattatccaaggcaaaaactcaggagatctctttgacaacttgcttctattccacatgttccctcccaaagactcctgtttatttgccactaacccctgtggattcaatctcttttaatttggtccacttcatgccatttttactgacattctctgattatattgtcccttttctggtctccatccattcctccgggctcccctcggtctcatcttcatacagcagccacttactttggaagtcattatgtaggagttatcattgaatccctttgttccctcactttaccctgccacattcaattttcactaggagtggcgcaggatgaatagaaaattataagtctttgacaaagaaaaaccttaaaaacatgcataacctacccacttctctccatctctagtactacctccttggtccaagtcatggccatcttttacctaaagatgactccaatagcatagcagtctccatctccctcccatacattctacacgtcaggtctgtccattcatctctcttacctgctcaaagttctccaatgacttacaattacacttagaataatatctaagctcctcaccatgcttagaaggtcctacaaggtgtggcttccacatgcctctcaggcttctccttgtaccagtctccactttggtccagccacacttgccttcctactattctctgaaccttacaaattcattaccattagcacttcccttctttcatctttaatctttctgattaaagtttcttgtcaggaacgtataagcattttcttgtcacactagcagtatataaggaatagaaaaatgtgtgttttacaaagaaaaactcttaatattgttttaacacctttcaaagtaactttaattaaagagacaatgtgcaaggtgaatcagaacttcatgtactgtgaaagaactggtgtgattccaaacacccagcatacttaacagaggaatgcaaatagtcaaaaatatattattaagcacaaaccaagactggttcttggcagtgtagccaaaattttaacagtgtagttgaaaatgtgttcaaccttaacctttcatctaaggctttcctttgctaatgaatcatgcctgtaactaaaacgctaaggttagcatggcttctttgaaatgaaccaccacaaaccaaacatctaaagcttaagatatagtgtttcttttcaaaactgacaaccccccgcactttttttttttgtattacatgaccagtcttcttgaaataagtgtggtctaggaaatctgacttttaaaattaattctcaaaaattctatttccccattgatgtgctgttagtatggtttgtcagtccaatttctgaaatgctaagtccatttgatctcccactaagggatcaaaccctattttaggacctaatatcaattttaaaaatttatgttttacctcagattataaaataatacaggctaattgaagaaaaatggaaaagcattaagagggaaaaagatttccataattcctgcactcagatataaccactattagcacagtgccttctttccacgtctttttcctattcatatgaaactggcacgttggctctgtaggactccctgagtgtaatcgtagaagcttctctctctcatctcccactgttcctttaatcctgcttagtggagacagttcttctcttgccccttggtgaaaattcagaagggtgccttgatttttcaggtcactctagtcctacagtcactttaaactgcagacaaagttttaaaacatttagatcgttctcaaccgaaatttaaatggttcttaagagcaatttaacgtaaggcaagacatatctaaaggattccagaacaccgttatttgacctatcatcaaggtacttttacttcctgtttgtctttgacccagggacttgaaccccagtggggtggtcgtggtgcctgcctcacacaccaatgtccctaatgatgactaagattggactggatgtgtaggtgtctcctggcctcaccctcctacttgttatattctgttctcctctgggagtatccctcaacgtctgttttatcctatttccccggcttcagctctttgttgcaggtctctgtgcatttttcttggcctgctggatgaatactcctcttcactctcatctcccttctgcagataaaggtcaaaataacaataatctcccctttatagggaaataagctgcctgaactccaggttcttgcaagagagtaaaacatcaaatctgcggcctaattataataaaaagattactttaattaactaacattaataaagatttgcaatatatatgttacaacaattcttagatatttgtatcagtctggtttcacactgctgataaagacatacctgagactggataatttataaaggaaagaggtttaattgactcacagttccacatggctggggcagcctcacaatcacggcggaagagcaagggacatcttacatggaggcagaaaagagagagaatgagagccaagtgaaaggggtttccccttatgaaaccatcggatctcgtgagacttattcactaccatgagaaccgtatgggggaactgcccccatgattcaattatctcccactgggtccctcccacaacacgtgggaattataggagctacaattcaagatgagatttgggcagggacactgcaaaaccatatcaatattcaaattttaattcatggataaaaccatcatctggttccaggtggaagcatgtgctttaggtgtgtgccatcagtccacattgagcggcattatacaaaatagctctgagaaacttgatactgcttttcctttaagaatattcttaagaacatcagctacatcttacagtttttcttccactgatctttctttgctctgcaatgtcttctacattgctaccaatgatctttccaaaacaaacctgactgagatcctctgctgaaaaatcatcagtagttctgctctatctacagaataatttcagacccctaagcatggcatatatacttgctactcaacgcctgctctgagagccagcagcgttgtaggatcttgagccctaccccagactgacagcatcagagcctacatcttaacaaaattcccaggtgacctgcaggcacattcaggtgtgagaagcacttatacagtgcacccttcatgagggtcctacagctgaaattcctctctggtgtcagtgctaggaaaagctgtgcttctcctgagcacttgacttggtttctattaaggacacgggctactgaaattcgatttcttcttgtctttagctgctatgaagcccaggccaaacatggagctctccttatagcagctttattggacttcatggcaggcattttgtttatgaattctattcttgatttcatattattttcatatctttttttctgtgattttcttattaatttttatccttttgtaccatatgcatctctctaagtcacctgaaatacttttagggatttggtgaggtatgagcccatgatatttgtatgcgtgtaagacagcaaggaagtaataaagtcaacaaatatttcatttcctggcctttccttgccctaaatggtatgtttaacaccagtgctaacttctcccaatccaacatgtctgtgtgtgcagaagcctcatgtcagatactttcgtcacaaacctagaggtattttccatagaaacctcttatgtaagaggaactgaagatatgaaggcaagagagcattggtgttaaggctcgtggcaggctggatgtcacagtgggaggtctaggtttctctgtagcttaagaagtgcactggccatccaggtcccagcttactctgcgtccccgctcttttctaaataaggactttctgctgttggtcttttctgtcatgagctgggctccaaagtggcaaccttcattaaaaagtgaaaactgggcgcttctgtctaaaaactaattaattcctgtggagacataagacaaaacacaaacaggttcatgtaatgacagtcaactgcttgtcatggcattcctgggtgagacagcatggctcgttggtggcgacgagtgggtggcgaactggagcttcactttctctctagcagcgtggctggaggcaggacatgtgacctctttgaacccatgttttcatctatatcacagcaagacatttgagaggtcatctcccagcactaaattcaactgtcatacgatcaattgagtttctagtattagagaggtcattagtctagtggtgaaaccttcaaatgcatggtagagtaatgaagcattcaaggtttccagtctggctgcctgagttggaatctctgctccaactctttgctagtcatgtgactttgggcaagttatttacatttttctgggcctcagtttactcatttgtaaataaaggaataataacagtacctatctcatatggtggacatgaggattattacataaaaacacaatgttagcacatataagagctcaatagatgttagttgctattttatcacaactggggaataagaaatgggcaaccatatttacctatatgttatatatcacacttttgttaagtttttgtgattatttttcttatggaaactctatattagggccatctaactgtatactgctgaccaagctggcactctccagctttttagaaattcatcaagattttatcaaatgcctgagtcaaagcatttgtgaagtcaaaacatttttaacataaatttccattccctctatctccccctgctatagtcacaaaaatgaacaaatggcaataaagtacaagaagtgcaagagggttgggagctcattcacgatcttctggtagagcagacagattccactttctgtttcaggtaccacgtccgttaccaaacaaccacacgactgaacacataactcccccgacactttgcccattaccaaagtagcatgtactcactgcatgcattttggcaaagtacaagggtagaaacaaagcaaaaataaaacaccactatcactttccccacagccagaggcacctactgctcaggttaatttgcatcacagagtccatcgactgctgcgagtgctgcatgcccagcagcccttccctgcttggtcagagggcactgccaccctcacaccaacatctgagagtcagcatgttgaaagggagacttaccaccaccctctgttcatttaatggataggtacttgaatgcccactgtgctcaacaaaataatttttgagatgccataagtaaggaaaatcagagtatgaaattaatggtctggccgccatggggcaattatgatcatttcttctgtaattcatggctatgatatacagaagatgaatagcggaacaaaaaataaacacctccttatccacttcttttagatctctaaggagactgaaatattctgtatttatatgtcaggtggaacgctgcctggagaaatgacggctaacattgcttatatctcaggcagaaatagtttcaagtacttttgatttatggcatattaaaaatgcttgcagaaataacataaaacaggacagggctattcgcgtcactatcctcatcatgtagttaccgccctcttctatctgactggcaaagcccagacaaacatataatttctgctgtgctgtggggcttcaaaagggctttgagcaacaacaaaaaaaaccctctgcttttttcaccagcaaatgtaaatagtgaccaaaatagtactagaaagtaagttgggttagaactgtctgggtcctgctctaattttcacttttgatgaggagatgtgaacaaagactttgccctctgtgtaggtgggtgctgtgggcgatactcaaaagcaagaaccaagtaaggcagagagctgtgcttatcggcagtgcagaactataatgaggcttgcattcatgccaaaaatcaccttcgccaagcaaaattggctaatgttgggtcaggaaagagaaaactggacataaaaagtaagaatggcagacataaggcacaaaataattggaaaacacattcaaagtatagcacactgacaactgaaaccacagtataatcaccatacattggtcattctcactttccctgcatactgtttccattgctgtgctttacagaaaggtaggtagacagtacatggcaactcaggattctggcagctttatggaaatgcataatatgtgagtagggtgtgtctttctaccagctagtggtggtccggggggttaccaggtaggcagacaattagaacctgtggaaatcattaaaattattacgtagccttctgaaattgctgtttttattctggggaacagcaaatccaaatctgcacaggatacaaattatattaactttggaaacaaaaacataataaaatctaaatatagctaatgaaaacctatactgtctaaagaacaatttagaatttattttaagagctgtaccaaagtgttgtgctacacattggttcctagaaaacatactcttgtgaaggcaaaattcaaatatttcacaaataatagttcgtttcaatccctccatttctttaacagctattattccctctcacgtcaagtcaattgactttctttttttctttttttgagatggagtctcgctctgtcgcccaggatggagtgcagtggcacgatctcagctcactgcaagctctgcctgctgggttcacaccattctcctgcctcagcctcccaagtagctgggaatacaggcaccagccaccacgcctggctaattttttttgtatttttagtagagacggggtttcaccatgttagccaggatggtctcgatctcctgacctcgtgatccgcccgcctcggcctcccaaagtgctgggattacaggagtgagtcaccacgcccagccgtcgattgactttccttcttccataaattcatctccaaggagctgaagaacaccaaagccacctcttctctctcggtctggccagtcttcatctgtcaattggattttgttttcttttttaggccacactttgaaaggagcctttgaatgtcagttctctaagccttgaatatgccccttgcctaaattatgcaagtatcctctaccttcccctcttcaaaaaggtttgatgattcccaagagaatgtatccctttgagctccaagcatcatctctctcctgtcactctcttccatacataggtaaacacacacacatatacatatacacgtgtgtatatgtgtatatatctctcttcatgtacatatgtacataaatcttgcccacaatgtaaagatgtaacatatttagttaattctgcttgttacatctaatttattctgggctgtgataacccaactgatcaaaatgtgaaaaagtcaacactacatattttatggatcttattagttttggatccatatgaatatcaaagtttttttttaataattattagccatttaaatgaagatgaacatctttaatagtatatatatctgtcggtttactcttgtcaccttactgtcagttcagaatgtgagcccagacctagcatcgctttccccagctcctaaaaattacatgactttgccgtcttcattcattagccacctgcgtacctagccatactatcagttctttcattttctctcctagcttcacctccattttggaaacccattcaactactcacaacagtattgtattattatttggaattgatgcaagtctgaaaaattaagcaatcccatattctggtaaaaatagcattaccaaatatttatatacaagaaaatattggtatatttaggcagaaaaaaatagtctaccctagatgatgtttagggcacatgtaggtacaatggaggatgaggggtaggcaggctagtggagctgttaggcagtggggagcagttgaaagcttttgagtaggggagctgtatgaatagacctgaatgatgatacatgattgacttatttgcaacggtaatactacaagcagcaggtggagcagaaggagcaaggagacccaggaagagtccaggggagaagtagtaagtgtaaagtggattagggtaatggtaacagaaaggaaaagagtaatacagagccaggaaacaactcatgtgatgtaggaagagagaagggaaaaagtcagctgacactctcagtccaatttaagtcaggagtaataaggatggaggggaaatatgctgagttctagaggccaaaagatcatccacgcagaggtgtctattcagtctggaacctgaagagaagccagggtcaggtgctcagtcgggattgttctgcaagaggaattagagttgaaattgtaggagtgagtgagtttgctaagagagaaagaatagagagaaaaacaacataaaactttggggcagaatttatagttagagtccctgaagagaaaagaagaggcagcaaatgtattaataaccataaaagaaatttttttttttttagacggagtcttgctccgtcgctcaggctggagtgcagtggtgtgatctcggctcactgcaagctccacctcctgggttcatgccattctcctgcctcagtctcccgagtagctgggactacaggctcccgccaccacgcccggctaatttttcatattttttagtagagactgggtttcaccatgttagccaggatggtcttgatctcccgaccttgtgatccacccgcctcggcctcccaaagtactgagattacaggcgtaagccactgcgcctggccaagaaattttaagtgtagtgtagaatctggggagtcaagggagaagaggatttccaggaggtggttatcagagttgaatgccgatcaggggagttagggggatttgtgatgaacattatccttacaatcatcacccacataacaatgatcacaagaacagcaacgactactacagtactactgttactgttgctaatactaaaaatatgtaggaggaagttgattacttctaagcatgtagttttattggttgatagatgtaaataaacaaatcaatttcttcattcaacaaaaatgtactgagtacttataccaaaccgagcactggatataaagcaaagaataagaaacgaacgcatggtaaaagcagagaatataggcatagccctactctttttctttctttgttttttttttgttttttgagacagagcctcgctctgtcgcccaggctggagtacagtggcgcaatctcggctcattgcaacctccacctcccaggttcaagcaattcttttgcctcagcctctcgagtagctgggattacaggtgcccgccaccatgccaggctaatttttttttgtatatttagtagagatggggttttaccatgttggtcagtctggtctcgaacggctgacctcaagtgatccgcccaccttggcctcccaaagtgctaggattacaggcgtcagccactgtgcccagccagccctatgcttttaagagttcgatggttgaaagagactgagcggggaaggtagagcggggcaggggagggactacttggagtcaagtcaaagttttagggaaagacctgaatctgaaaaagattatttaacctttatgtgtctgaaatactatattgtgcgaattgtaccgtgagactcatccaccatttataataatgtttctgttggaaaatgtgttcaaagtttccatctgggatacaaggaacacatccttccttgcaatagtcttggtagcgtaatcaattcaaaatgtggggataataatgaaaatgagaaaaggaaccaggagactatgaggaaaaaaaacaactgaagtgcatgatgctgtagaggggcatttcagggacaaaggggttccaaggcccttgctaggaacaggctggggcaagaaagtgacaggaatggaaggctgggagtcatgctttcctgactacaggtctggattctagaaatcatttattattgccatcccctttaaatatgaaattgcatttagaaccttcagaagccaggagtctgtaaacaatggtgcaaacaattcaaacccgaagacattctcagctgcaataaaatttctatttacatgttccattttttaaaattcctagaaaaatgctacttttatgactgggctctcattgggaaatataatttgctcagctaaataaatctgtatatttcaggacatgtaaccacatcacacttacaagtctttgctatgaatttaaaaaggttccttgcccctggaaacagccttttaaaggctgttgtgggcctcacgcaagtggctagatgggcggtattcagcacacatgtcctgtctttaatctagaatgatctcacaaacacaaaaacaagtcagtcccagaagagagaagattccgcccctcacccacaaaaaatactagaaataggacaaaaataaggttttgaaacttatttgctggttttcagaactgccatattatgacgactatccttaatacttatcttttcttttggttggtttttcctccctagcttttgaatcctagctcttccttctggttccagggcttaaccaaaaggcagatatttgacacttgaacacgaagttcagtgtccagcacagtgggcctactttatggatgctatacagtaaatacaaagcactgctttgcaaaatgtttgtttttcttctcaaaccctgtatcccaaactctcacagcttttgagttttaattttcccactcatgatttcttggaaagccagcaggtagagaatgtgtgctcaagtgaaggcatgggtggctgaaggtgaaaatgtttaaaagggtccctgacttcttggccaggaagaaataagcaacacaaaagcagggaagccaactgaactgaaccgtccactgacagtcatttaaggtggtgggctcactcattaaaaaccaaatggaacaacaaaaaaaatcctgtacattttttttctgataacttttctctattaatataaaatttgacttgtctcttcaactatccatatataactaaacaaaagcacgggggcataaaagtgaaattttgctatattttaactggaagttgcatttactatttaaatttcaatcaaatatttactatttttggctgggcgcggtggctcacgcctgtaatcccagctttttgcgaggctgaggcagatggatcacctgaggtcaggagttcgagaccaggctggccaacatggtgaaaccccgtctctactaaaaatacaaaaaatctagctgggtgtggtggtgggcgcctgtaatcccaactactcaggaggctgaggcaggagaattgcttgaacctgggaggtggaggttgcagtgagccgaggttgcaccattgcactccagcctgggcaacaagagcgaaactccatctcaaaaaaaaaaaaaaaatttactattttttctgtagaatataatcaatgatggggtttttgcaaagtacctccttcaactcatcccattacaatactatgttttcatgagccccttaattttaatgtctatttcagtggaagttcaatgagtatctcctaaattctattgactttattttgggagggtttagtttagctttctttctttttgtgatctatttgtttatgcttattgataaaatcaaagggatttttatgtcatgaaataatatggccttaacatggatgaaagaaaaacttggataaacattacaagaagaaaggaaagggaaatccaacattgcagaccttctagatagtttagggactgacgattgagaagggacagaccagaaagtgttcttatcttggggttaagcctgtaagtgtgattgttctcttagccctaaaaattttgtcagatgtttccacgtgaaaccttcagagaaacactataaataatttgcatcagagagaggtagagagaaagggaaagaaaaggcaagtgggaaaacagatctgaggactcacccccaagcatggaaaatcgaggatgtggggatacttaagaagttaaatttcttgttttctctgcatatgtgttgtcacatcactgaagaaagaaagtgctttctgaaaggaactctttcttgttgcatgcctttcacacaacagtgggtttacttgacagtgaacactaggcacggggctctgctgtgaacagccctgttcttgccaggattaggggccagtgggaggtgcaacagcacccagtccgttgcatctggctctactacagcaggagaaccaaagggcacaagaggtgaataaagaatggaacattagtccgggcgcaggggctcatgcctgtaatcccagcactttgggaggaccaggcaggcagatcacttgaggtcaggagttccagacctgcctggccaacatgttgaaaccccatctctattaaaaattaaaaatacaaaaattagcccggcgtggtggtggccagctgtaatcccagctgctcgggaggctgaggcacgagaatcacttgaaccctggaggcagaggttgtagtgagctgagatcatgccaccgcactccagcctgggtgttagagtgagactcagtctcaaaaataaaataaagaacataaaccagtcctagaggctggaatggtccaggaaatctgtctagaaacagagacatccaagatgggacctgtaggaagagtaggagttggccagaagaagggagaagaaacagcatatgccaaaggctgaagatgagagaaagctcatcctaactgaagattttttaaaagatcagcactggtagagggtgtgagcagcaggaaaggaagaggagacagagaggactggggcaggcagggcagccttgcgagcgcatctgggctgcatcctcagggccgtggggacccagtgaagaaagatcactctggatgtggtgtggaggagaggttggaaggggacaagcctgggggcgggagcctgttcagaagcaggggagggctagtactttcctgaactaggggaagggccttgtgaatgcacagaagaggattagccaagctgaggctcagagggctgggtgatggactgctcatggcaatgaaagagaggaggaaaggaagggttggatcaaatgggtggacactgacatgaaccgcatttgggaacacaggaacggcagcagcaggtttaagggggttcagataattatttccattttggacatggagagtttcagttttcagtaggacatgtcatctgttttgatatccagggaggttttggaaagggctagaacacactatgatctaaaagatctgggctagagatagaaagttgccagttgtcagaacataggtggtagtgactgaggttgcctaagagagattgcagagcctagtaagaaaaggaagccaggaacagtttccctgtggagcaacagggtttcaaggcaagagacaaagaggggccgtgaaggtttctaggaaagagctgtcagagaggcagagggcatcccattgtgtcagatacttcaggggagtcaagctggtaaagacagaggcagcaaggatgtcactggcaaccggaagagcagtttctgtggattgatggcaacagaagctggactgtaaagtaataagaaatgagcagggatggagtacagacagaagctagaagggaaacgggattaagatagatttatttaatatgggttacacttgaacatatctcaacacttattgaatagggcctttttcagtaatttaacagttacataaatatatgtaggacctattaagtagcagacactattccaatgcttttcaaacattagttcactcgattcttgcaattcctatgagacaggctttattgtttctctcattttggaaatgaggaaactgctgcacagagaggttaaataacttgtttgagatcacatagtttctaaatggtgggtctgggatttgaacctaggcagcctggttccagaatccatgcttttaagttttatctctctctctctctcttttttttttttttttttttgagacggagtctcgctctgttgtccaggatggagtgcagtggcatgatctcggctcactgcaagcttcgcctcccgggttcatgccattctcctgcctcagcctccaagtagctaagactacaggtgctcgctaccatgcctggctaattttttgtatttttagtagagacggggtctcaccgtgttaaccaggatggtctcgatctcctgatcttgtgatctgcccgccttggcctcccaaagtgctgggattacaggcatgagccaccgcgcccaggctttaagttctatatctctctttaacgcaacacatggaagataatctaagaggatactttaagccttaagaaaaatgcaacagtggtagcatttaaaaagactgggctccaggtaatacttcatagtttggcaaaggttgaaaaattacttaaagtagcacagagcctgacatcttcataccactgtgctggtatccttccaaaaataaagaatgctgctgtattgatctcttttatttatatattgatcatctagcatcatagaaacaaatcatttgaactaaatggattctcaaaacaactggcttcctcttagaaaacaaattcctcaggcttcttgcaaataaatcttggcataagtgtctttgctgagcttccacatctatgaggctgcaagagatcgttattgatcaacagttccttcctttggaacgctctttaaattagttagtgtttaaaaagatgccttttcaaataataacctcttttctaaattggccttagacattttgtttgcaaggaccactagcataattaaaaaaaaaaatcacagcaagcaacaaagccaactattgaaggaaagaaacatttctcagactgcccacatgagaaatggctttgctgagccccactctaaaagccaagggaaatttctgcttgaattgcaaggaaccacagtagaggtgagaaagatgctccatccattttagcagctcacatatattttaaagtaaaagtagtgttttcattttcttgcgcatttgactatgtggagtaggaggggaagaccaggcttagaagttctggatttgagacttggtgttgctaagagctgcctaaaaagaaccaggcacttaccctcaggtgggcttaagattttcatttttgaagtgggggatgagggtagaaagactgggaggtcaatagagccaattttctttctttctttctgttttttgagatagagtctccctttgttgcccaggctggagtgcagtggtgtgatcttggctcactgcaatctctgcctcctgggttcaagggattctcctgcctcagcctcccaactagctgggattacaggcacacaccaccacacccagctaatttttgtatttttagcagagacggggtttcaccatgttggccaggttggtctcgaactcctgacctcaggtgatctgcctgccttggcctcccaaagtgctgggatgacaggcgtgacccaccatgcctggccagtagagccaattttttaaagattcttttcagcttcaagattctgttaatcaatgaaataacatggaattatgatttcagctggtataaaagaaaacagattcacatgaatccagtatagttaatactctgcttattaagctttgttaagaacagaagaagaacggatgagagagaacacgatgtttgagaacagagtgatggtgagcttaagtggaaaactgccatttagaagaaaagaagatcagaataaaaacctagctagaaaaaatggggcataggatctgaaagacaagtctgatatttgaagtgatcggagctcaggatcagtcttcgtgaaaaagcattaggtcaagaagtgaaatggtagatttgtgaacagcaaggctgaaacagaggccacaacatggaagaatatccattgtctagctgggagggatttgaggtcaagcgcacattctgagcttctccaaataagcctatctacacagtatctaaccaaacaccatacagtgtgttccgaagaatacatgtgcttcagatgtagaacacaatccatcttgtgatgttaatgacacacttgttttatattcaaacagggagcccaaactgcttctgtgttctgttccatggtaggtagacatgaacttacaatgagatgctatttattaaccatgccaaagaaaaaaaactggccaaactcggagactttgtaaacaagaatttgctgacgctatttttaaaaacaaaatgaaatcagataagccagcttggaaaatagagaggaaagtaaatatatctctccaaagaacatcaatatttgctaaaatatggaataattagttttttaggcagcaatgaaatactacctacaaaaatgattcactgtattaaaactggcagtccagttgaggtcttgtaagcgttgtacaggaagccaagtttattgggaggaacctgagaagagctcagttctccagatgagagaatacaggctaacatcacttgcgaatttggaatgaatctgctactagaaacggcaagaatataaaagatgggaaaaaagtaattgggaagaaaagaaaaataatgcttgtctctaagaatgctgctgctttgttttatgaactagtctatttgttttggctccaactaaactcaagaatgtttctgcatattttacagtgtagtttatagacatcaaaggaacaatctcccctttcatcattatttacacataaaaataatgcaatttgtggtacatgtaaaatgttacttcttaaaaagctctcgagtctaatttattaattgcttgagatttaaagttaaacaagggtgagatgcaaatcatctgttactctgaaatattttaccaccaaatcctgttttattaatgagatgttgagcagccatatgaatatttatttaggtggttagagggctttatgaagaatcctacagcaagtgacagagacataaaagctgaagggttctgcttctcttgaaaaaatgggggttgttcttttttttaattccactttttcctctgtgtttccaacattaaagcattcctgtaacccaccaaccatcccggccttcttgctccaaatcttttgcctttgctgctactactgctgctattatagcaatagcctcccattgacaactcgggaaataacagcctggtctttttgggtggcaggacagcatcacattaatttttgccaattacatacacttgaaaaacatgatatatgtgtactactaggtttattttgcttaatttattgattttggttcagttccttagaaactgcataatttaccatgcgatattatagatttcctgatgcagtagcaacaagtcccttaaaaataactatataaatgtaaaatagaatgcgctagaaatgtctttaaattgttccatgatttataaggcacagttatgcagaatcagttatgataatacaactgtttattcataacttcacttttctctcagtagcatataactactattggaaaatatacttatatatgcatatattcattctttttctagaaatgtttacacacatgtacaacatacgcatacattctactttcttttaaaaaattatacatatgtctcaacctatacatgtaaatataggatcaggcacaatagtgtccgaaagacttctgaagtcaggtgttaaagttctacagcaacaaagatgatctgaaatgaagtccaccaacaggctggctctcagcctagtcctgccctaggggtaattcttgccatttcagtctagcccctttacccctcttccactgcacagcccctcctgctgcccccaaggctgcccgctccccacttgcagacaccttcaagctctattcctcaggttcctaaatgacttccttgccctcttcttctcccttcctgccccaaatacctcctcctactccttcaagtgagatgatctcatctaattgttaggaacaaagtctctgattgaacagtttcacattagagtgtgaattacttcaagtggtttaatatgttaatatatcaaggatgtctgaatcttaaaagaggagtttgttaaactgaaggcttagatatttaactaatccaagaactaacattttgtgggggtggggatatggggtccctacttcttttaacagtaaggttggtgttgatgtgtttaaagctgccttgaaaacaagcaataataggtataaaataaattaatatatttagtaaccagggattatatgtgtatatatatattttgagacagagtctcactctgtcacccaggctggagtgcagtggcacaatctcaactcactacaacctccacctcctgggttcaagtgattctcctatctcagcctcctgagtagctgagattacaggtgcgcaccaccgcgcctggctaatcttttgtatctcgtagaaatggggtttcaccacgttggccaggctggtctggaactcctgacctcaagtgatccagtcgcctgggcctcccaaagtgctgggattacaggtgtgagccactgtattagtctgttttcatgctgttggtaaagatatacccaagactgggaagaaaaagaggtttaattggacttacagttccacatggctggggaggcctcagaatcatggtggtggcaagagaaaatcagaaggatgaaaaaacggaaacccctgataaacccattagatcttgtgagacttattcattaccactagaacagtatgggggaaactgtccccatgattcaaattatctcccactaggtccctcccactgggtccctctcgcaacatgtggggattatgggagtacatgatgagatttgggtggggacacagagccaagccgtatcagccaccatgtcaggccagtatccagggattatattctttaaatcaatgaagtctttatgtttgagcacccagtactgtgggtgttatgaagaaacgaaaagtgtgaggcatgaaataatcaaataattattggctgggcatggtggcttagcactttgggaggctgaggtgggtggatcacaagttcaggagtttgagactagcctggccaacatggtgaaaccccgtctctactaaaaatacaaaaaatagctgggtgtggtggtgggtgcctgtaatccaagctacttgggaggctgaggcaggagaatcgtttgaacccgggaggcagaggttgcagtgagctgagattgcaccattgcactctagcatgggtgacagggcgagactccatctcaaaaaaaaaattattattaaggattaataacaggacctcatgaaagtgtaaggttcttgaggactggggcaatcagcagagcttcatggaggagggagataagaccttgagatgataaaacttgacaagtctgagggttaaagatgctgctgaggaggaaggtgaacagcatgagagaaggcaggttgcgtggctggcaaggtgcttgtggatagtgagaaccagcttgattggaagagaatgtgtgtgtcaaggaatagtgagaaacctggatgggctctgaaagctaagcagaagagtttgatcatgatgttataagcaaccctctaaattcaatttagtcatacgacgttttcagaaattaagacatcatcaaaagatataaaataaaaaatggaaagtcctattgcccccaaataatcactattacccatctggagacctactcaggacatctttttatgtatatgacatgctgcactcttttcatttattatatattagcaatcttgcctcattttcaaagagatctacttcattctttaaaaatggcctcataatattccattgtgtggatgtgtcataatttgctttccccagctttttgctcaaacaatcctgcaaagatattgtatagacttgcaagtatatccagagatagattcctgtcagggggaactgctggcccaaaggttatgtgcatttgaatgttggtagataagaccatactgccctccacagaggccacactggtttatactcccagaaatggggcacgagcctgctggtttccctgtatcttcatcattgaccacgttttcaaaatgaaaacttatactggtcgggtggcagtcagtctcttcaaaactttggacttctgatttacatttatttgattatgagtaagaatgagcattttttttttcataagtttgctggacattgatgttctatgaattctgctttcatgttctttgctctttttgtccactgggttgttagttttcctattgatttccaaaccctctttgtaagacaaggacatcacagtgatttaagatttctttggcagagttcttcacactggactgaagctgagagccttttggcagggatatcggctgagaggaggctgttttaaatcaatcgcaagttgagaagggctccaaatagggtcatatcagaggaataagaaatacattcaaggactctggtgagagacttgagataaattgggatgaaggaaagaaaggacaaagatgaactcaaagtttctaacaggaaacagaaagactggaggtaaccctgatagactggaaagaagggccaatttggaagggaagatcacaactcaatgttgtagatggtgactctgaaatagtagtgcatcttcaaaagaagatgatttacaggcagtgcaacatataggacccagctaggaatcaggccagggcttctgggaatcatctctatagaagtgacagctgacatcacagaggagatgatcttagtgtggaaaagaaaaggagaagcaaagcccaggacatagactcgaggaacacccactgggaggaagagagactagcagaagaaagacaagtaaaagaagtatcatataagctaagataagataagggttggcaaactacagccagctggccaaatctagcatttaccttggttttgtcaataaagttttattggaacatagccatgcccatctgttgacatactgtctatggctgctctcaggccacaacgttaaaagctaaatagcttcaactaggactatatggcctgcaaagcctaacatttttactatttggccctttacagaacaagcttgacaatgcctgttttagaaggaaaattgttggtcaatcaatatagtcaaatgctgcatagagctagaggatgattagaagtagaaaaacactgtggaatttggagaagaggcgataggttactctgtcaattttctatattatggtgggattacaaaagggactttaagagaatagatggaagagttgaatcatatacacatcagaaaaagaacaagaggttggtagctaggaagggttgcaagagaaacaacgccatacagtctatccacttgtctagagaccacactctgcttgttgggcttagctatgactatagggcctggagctgtgagtcaatttcatcaaggacatgggagaaagagaactgttgtaccagtggtacttgagtaaatgtattcaagtacatttcctgcaccttatgccattgtggtataattgcctatagtacagcatgttactatactgtaacattactgtatcattactgcactataggcaattatataaatatatctaagcaaagaaaaggtacagtaaaaatacagtataaaagatacaaaatggtgcacctacatagcgcacttaccatgaatggagcttgcgggactggaagttgcacttgtgagtcagtgagtgagtggtgagtgaatgtgaaggcctaggacattactgtacactactgtagactttaagatactctacacttaggctatgctaaatttataaaacaacattttctttcttcaataatgaattcatcttagcttactggaacactttcactttataaacttaaaaaaaaatttaaactttttgactctttggtaataacatagcttaaaacagaaacacattgtgcagctatacaatattttttcctttcttaaaaatttatttttatttgacagataataattgtacatattccgtttttctttatatccttattccataagctttcttctattaatttttttgtttttactttttaagctttttgttaaaaataagacaaaaacacacacattaggctaggcctacaaagggtcaggataattaagaagttactaggtggtaaggttttctcatcatttatttcattgtaatcttatgggactaccatcatctatgtagtccatcttgactgatatgttgttatgtgacatatgactgcatacataaatatgtgcatatacacctatgtagcatatatgaggctggtgcaaaagtaattgcggtttttgccattaccacaattacttttgcaccatctaatacatattaaattgatcattcagtaattttggttgctaaggcttacatttatgtcattcaatgatcattacgttcattatactgcctttgaactatctccgatacagtttagcattattaaagattaacaatgtccaagtagttttttgttaaatttttaaaattaaaaaactaaaattatccatatatattccaatagtttactaaccaaagtacttcattttggaccatgcaataatacaattaaccaccagcctgggcaacatggtgaaaccctgtctctattaaaaatacaaaaactagctgggtgtggtgacgcacatctgtaatcccagctactaaggttggggtctgtggagggaggatcgcttgagcccaggagttggaggctgcagagagccaagatcgtgccactgcactccagcctgggccacatagcgagatcctgtctcaaacaaacaaacaaacaaacaaacaaacaaacaaacagaaaaaccaattaaccatatatagtcacctagtgacttccaaagagtacaatttagccattggtgaagaggaatctactttcacctgtgttcttttgatcacactcttcctactcacatattcgtgtattcgctcatcaaaccttaattgattccttaacgtacacaaggcaatgttccaggggctaaaaatatctctcatagcacttgaaggattttgtccactgaacaaagaatcttatttgactagttttaaaataaaataaaaactgccagagaatagaatcggagggaagctttggggtaaaaaaaacttttgagagagaactgttcctttcttctccgctcatttattgctattgcttctccttgctctaggaagcaaggtcataattcacagccacagcatatccaagcctatcttccagagcattcttcctgaaaaatggcacttacgctttatgctactatgactgaatggctctgtctttctttctgagtgagcaggcaaaccttcttaggtgggatggaaaatacatttctattcttagcattattaattctaattcaggagggcacaaagaaaatgccactttccttgtgccctacggacgtgcatacaggggagacaggaattaagtaatgaacaggtcccaaacaatgccatttgatgctaggcatcgagatttcttcctgtttctcaatgctactaaaacaccacaatgaggtttgtaattttattccttgggaaattgattcctgtaagcttttaggacagtaagaattgcccaatcttatgaaatattctacaacccccaccccccgcccccaaccaagcccttctggtaacacagaccagattgctagatgtcctactggcagctgaccttgtcttgtgaactccagtcagtagccaagggagagaagcatcaatgctgtaaaatctcttttctatgcctgcaagcaaaaattttacaacatttcttcttgacatgaaatctctgcttggacatctggcttcacagtgagaaactttcaatacgctagcttcaaagaaaggacttagccctggtggtgcagtgatgccagaagaatgttccacagtctctttaaagaactatttctaacgtttccccaaatgaacttctgtgagctcagtggatagtgccaactcacatttagataacttggctttggcatacagccttttgtgggcattgcccctggagtatacaaattgtgttcttagataatacaggcataccgcggagatactccaagttcagttcctgaccactgtaataaagtgtataccatgataaagagagtctcgcatatttttttggtttcccagtgcatataaaaaagtcatgtttacactatactatagtctattacgtgtgcgatagcattatgtctaaaagaacaatgtatataccttaattaaaactttcttattgctaagacatgctaacaatcatctgagcccccagagagtcctaatctttttattggtggagggtcttgcttttgatgctgatggctgctgactaataagggtggtggttgctgaaggctggggtggctgtggcaatttcttaaacaagataaaaataaagttcactgcaccaattgacttgctttcacggaagatttctctgtagcatgcgatgctgtttgatttaaccacagtagaatttctttgaaaatgggagtctatcttctcaaatcctgccactgctttatcaactaagttgatataatattctaaatcctatgttgtcatttcagcaatgttcacagcatcttcaccaggattagattccatctcaagaaaacattgtctttgctcacccataagaagcaactcttcattcaagtttggtcatgaggttgcagcaattcggtcgcatctttaggctccatttccaattctagttctcttgctattctaccacatctgcagttacttcctcaaagtcatttgtgaaagttggaatcaacttcttccaaactcctgttaatgtttatattttgacctcctcccatgaatcaaaaatgttcttaatggctctaaaatggtgaagcctttccagaaagttttcaatttactttgcccagttccatcagaggaattaccatctatggcagctacagtcttatgaagtgtatttttgacataagaagacttgaaagttgaaatgactcctggattaatgagctggagaatggatgctgtgttagcaggcaagaaaacaacattcatctccttgtacatctccatcagagctcttgggtgaccaggtgcatggttaatcagcagtaattttttttaaaggaatcttttttttctgggcaggaggtctcaatagcagacttaaaatattcaggaaaccatgctgtaaaccaagctgcagtgcagcctttcttgttccactgaaaaagcacaggcagattagatttagcatcattctttagcatcctagggtttttggaatggttaatgagccctggccttagtcaccagctgcacttgccttgaacaagagagttagcctgtcctttgtagttttaaagcttctctagtaataaaagtcctagatggcatcttcttccaacagaaggctgtttcatctacacagaaaatctgtcatttagtgtagtcaccttcatcaatgaccttagctagatcttctgggtatcttgctgtagcttcagcacttgctgcttcaccttgcatttttatgttatggagatggcttctttccttaaaccttatgaacaaacctctgctagcttcagacttttcttctgcagcttcctcacctctctcagccttcacagaattgaagaaatttatggcctttgctctgaatcagactttggcttaaggaaaggttgtggttagtttgatcttctactagactactacaattttctccatatcaccacaaagctgctttgctttctgccattcatgtgttcactggagtagcacttttaatttccttcaagaacttttcctttgcattcacaatgtggctatttcgtacaagaggcctagctttgggcctgtctcggctttcaacatgccttccttactgaacttagtaatttctagcttttggtttaaagttagagatgtgtgactcttcacttgaacacttagaggccattgtagaattattaattgacctacatcaatattgttgtgtctcagggaagagggaagcccaaggagatggagagagatgggggaatggccaggaagtggagcagttaggatacacacaacacttattgtttgttgtctcccatgggtgcagtttgtggcaccccaaaacaatgacaatagtaacatcgaagatcactgataacagatcaccataacagatataataatgaaaaggtctgaaatattgcaagaattaccaaaatgtgacacagagacacaaagtgagcacagcacatgctgttggaaaaatggtgccaaaagacttgacacagagttgccacaaaccttgaattgtaaaaaacacaatgtctatgaggtgcaataaaatgaagtgcaataaaacaaggtgtgtctgtatatacaaggcgcacgatatttttttagaatctgcataattaggcaaaatatatgacggttaccacaagatctgagttctctccccatatctgctataccattacaaaatatttatgagcttgctgccactaaaaataaaatgacatgagaataaatgacactatttgttatcagaaccttttatgatttatgagggaacatcattcatttattctgtgtatttccagcacttccatcgaaacaaacattgcactaaagcttgctctcaaaaacctcacagtctagttggtgagaaagacaattcatctaaatacaggtccacaatgttctatctgcaatcctgaaatccaaaagtcctccgaaaaacacaaattctttttgaaagtctgcagttaacttctttgggaacaaaacctgactgatgttgggtgggtacttataatctctacttgtctcattcactggggacactcacacatttcactgttcctgtatgtgtctgagtagactgtgctgtcccaggacccactgcagatacagcacaagcaccactttcctagaacctgcagattcggactgggtgagggattgtgggtcagcactgtaatacagcaaacacttcattagagggatgaacgaggttggcacgagtttctcactctgatgcttcgcagaaaagatgaccttaagtcaaagggaaaggatactttacaaagaactcatgggcatttcccatggggcatgggatcatagagaacatggcatctatgttgagcactggcagctgatgagggagactggagggtgatgtctagacaagtggttctccaagtattgggtttcaggattcctttccactcttacaaactgacaaccccaaagaggttttgtatatgtggattacatctactgagtttatcatattacatattaaaactaagaaatattaaaacattttactcattaaaatagtaataaactcattatgtgtaaacataaatataatattttaatagaaaaataactattttccaaagcaaaaaaaattagtgagacaactagctatgtttcattttttgcaaatcttttcaatgtctgatttgatagaaggcagctgattctcaaatatgcttctgctttcaatctcttgcaagatgttattttgattgaagaataggaagaaaatctagtctcacacagataagaagttagaaaagggaggagtattttagcagcctttttagatgactgtggatatttttgttaatatgccaaaacttgacaagtggtagcttcttaaaagttagttacaatgtggaatctgaaactctatcagtgagcttttcatactattacactaacatccattggtctcttttgtattttgaatggatcttttactcaggcatggttttgtaacatcaggtgtttgtcatttggaaaacatggttctgtgagttatacaaatcttccaaatgttgatacacttcattctcttccttcccctttcttcccattcacatcactgataatatcactgatcttatcagaaaagtctgtaagtattgtgaggctgtcaggctcacagtggtggtattagttttccaaaattctaattttggcttgaaagcttaaattttatcattagcaacaatatagtcagttgttatccttgaaatgccaggcttgtttcatttcattcattttcaagaaaacatctgccaaatactcaattgtgaataagcatagcttgcctgtcaatcgttctttcagagtgactagagttcagctcatactcatacagacacagaactacttttctctaagacagccatcctacttcagtatgcagcagaagtgcttcatgtgtacttcctactaatgttaaaagagatgtatcctcgaggtttgagatttaacaaaatcaatacagacgctcttcaactaagatggtgttaagtctcaataaacccaatgtaagtagaaaatatcgttaaggtgaaaatgtacttaatatcctgattaacctatcgtaaagttgagaaattgtaagttgagccactgtaaatcagggaccatctgtatattttattgctttttatttttaaccataagtacatggtagtgaagaaaataatgactagtcatatggtttcatgttaaagccttgttttgtgtgaagccaccagcagttttacccaccactgcttctatatcatctatgcaagtatcaatatagtaaaaatggaaagtgatatctttgtgttattatgaaaatagtttgaccttgtggggccattgtaaaggtctcagggactcatcggagtctgcagagaataccttaagagctgctggtttagatcataaagtgttttgtatgccatattgacaagtataggttttatcctgtaggtaatggaaagccattgatgaattttaagaaaaaacaacatgcccatatttgcgttttagaaaagttaccttatcagtagtgtgaggcatagatttgagagggtcgagttattggcagtgattctagataagggtgattgtgctaggcaaggtcaaagatgatgatgatctgacctagaaggtaggatctagtgattggggaatggggtatgagtttggagatatttaggagttttctctaggaactgacctatgagaggtaagggaaggaaagaattaattcagggggatttctagggaatctgacttccgtgagtaggtggatgacggtggtactttaattcagataaccaatacaagaagaagagcaggctggggctgggagaagagcaagaggaagattaattcagtttatgacagctctagattgtacagtctatggtccatccaaatggaaatgcccagtagtagtcagaaatgcggattgagggctcaggagaaaagtttgaatggtgatgaaaattcaaaattcatttgtctggaagttaacatgaagggatgagattgtccagggacaatccagtgtatatagagaaaacaaaataggccctaactaataccattatttcagtgcaaaaaagaggagatgggaacaagaatgggaaagaggggttccgaaaggtagatgccccaggaaagtgctgccatagagctaaggaagtttttagaggctagtcatgtgcagattagatcgttgttcacagatgttcacggtcttctaactagagttagtatgtaatttccctgcctcattgacgtggacagaaatgaggctgaggatgcagggatttctttcaacccatcctcttgcacttctgtaatctaccattaacaggatattccggacaactactagtccaagctgactgtacagacatctagagctggcctgaatctgatctaaagcctggagtcaaacccagtcagtcaatgcacattctgaatttgagccacaacagcgacccgcagacatgttccaagaaaaataaatgtgagtgaaagtcactgagtctccaaaagtgtttgttaggcagcattattgtggtaatatctgagcagcagaagatccttgttaaatgttataaagaagtcaaatagacttctcaagattagatagtagattgaatgttcctctcccaacaccaaataaaatgagtaaagaagagtaaaagctagcaaaaatgcaccaacagaacaatatcgggtggtaaggtagacatcatacaaaaaaccatcaaaaacctggggtcaaggaaagaaatgtaattctggagcacagtgaagagttgcacaggggctcaacttcaaaacttgcccatgcccctaggatcattatgttgttatgagtcaaaattctgagaattttcaatactatcaccaaatctggagagaagcaaatggcatggcagcctcattttttcctcttctggctgacagtaggggagacggatgtggtagaaaaacagataaatatcagggctggctacctctgaggaaaggacttcagagatgtacaccaaattgggatcattacaaactcaaaggaatagaagatgccgcttccatgtaggtagtgtgaaccctgaaacacacttaacataatctcaaagtgagaacagtcagttcagccagatgcatgctggcttgtgcgccagctctgccttccccttccctcaggtcagagaacacacagagacactacaagtcagtttcacttacaaggagaaccactatgcttcagaaccatttgctattgaatactgaacatgtagacatatctcagtcgcttactgaatttatcctggttaatctactaaacttacatgagaaagaaagacttcttcaggaatgcctcagaaaatgcaaatcacttctaaggaggtgcattcagtctatgtctgttggtctgcagacagaaaagtctgcggggtcatgtctgctggtctgtctagcccaggcttctcatagcaaccttaaatgctcgatgagccgtgtttacacataggaagaaaatgtgaacagaaacaccgcacccatgtaacatgccattcaatcatacaggttagccagaagacattcttaaacatgaaaaaactcagggaagacagcaccatccaatcaattaagaaacaaatcaaagtaaaaactgtgggaatggcgccactatggtaaaaggcctagtataaacactgcatagattgaaatatagcatgagaattaaactataggatatggtttaaaaattgtgaatatcataaacccggacagtgtgaaaatactactactatccaaggtaggaggtggcagggaagggttacggcagaaagtataagggtgcaaaagtacacatttttcagccaaaatcaacatgttctgtccaaaaattcaacaattcctctgttttactctagtttcttttgtctgttgaattaaagtaaaattaaagatttttctaaaacaacaaaaaaaatcaatagtattcatttcaaaagcctactcggctttctgttctttttcccttatacatagtaggatatcagaaataatgtttaccttaattctatggtggttatttctgggtgataggatttggggtgactttaaaaactgttacagttttttattcttgcattttaaattatttataaatgagcatatgacatttctactacttcaaaaacaagagaatagattttctttataaaaaaacatggatgcaaatatgccgcaatgttaattaatgttgattacaggtagtaggaatatagatattttcctctttgtactattttgtatagttgaggaataaatgggagataaaaaccggacctttagtatagactactgtggtagatttaaaatggcctcaaattctatgccattcctcccactatttctcctctcctagattggccactatttctcctctcctagattctgggctggccctatgacctatcttgatcaatcgaatgtggtggaagtgactttgtgactcttcctagggcagggcttaatggaaatacaggttctgcttttaccccttttaattatttctctttgacatcagctactaggtgaaaagtctgattaatctgttaaaaaggccatatggcatgggcctgaaaccagctcagacattccaaccccagccaagctttctgctgaatgtaacctcatgaggcaccccagccaatgccacacattgagcagatgaaccacccagctgatccctgcccaaatttctgatccaaagaattatgggcagatagatgttgctctaagccatcaagtttttggagtatgcagtggtgataattcttttgaaaggtgtgactttgaacataaggagtgagctaaggcagtaaataagtgataaagaagatttttttgctcttgatttttaaaagatagggtgttacagcataaaagatctactcttgccaggtgtggtggcttatgcctgtaatcccagcactttgggaggctgaggtgggcaggtcacctgaggtcaggagtttgagaccagcctggccaacatggtgaaaccccatctctactaaaaatacaaaaattagccaggcgtggtggtgggcacctgtaatctcagctgcttgggaggctgaggcaggagaattgcttgaacccgggaggcggaagttgcggtgagctgagatcgtgccactgcactccagcctgggcaacagagcaagactccatctcaaaaaaaaaaaatctactcttacgaattttgttcgtttgtgtaactctttttacactaaaggaattctgttttctaaaagaccttacttcatctgttgtttcttggacagtgaggatcatgcctgctgttagtctcacctaccactattcccataatgttcaatggatttcttcaggctggtagcttttccctttttaccaaacaatttttattgcttctctgtgcaaaagtgctattatagtttaaatatagataaaattaaaaaatcataaattctaccactcagagatatccattagtaaaattttgatataactgtagtctttttttctcttgagttatacttttgttttgcaaaaatgagctcatatctatatgttttgggatgtgcattttcactgaaaaatatcatgtgaacattttcaatatccttatatatgctctccaacgtcatttcctatagtgcacagttttcagtgtatttgctatagttaaaaatatagaaaggatatagagaatgctggtgttgcaggtacctgtcacataagaggagctaaataaataactattgactgaaaggatgaaagctagaacaagcatctttttgattagctaaagcttagtgcgattattaattgccacctttgggcaaattctgaaaatggtcaaaggctaggtatatctctcaggcaatttaataatgataggtattgccaaattatcctcaagaaatgttttatcaagttatattgcacctgactggtgaccctttaagtgggtttcagtatacctcaaattttctctagaattactttaatgatttatctgaggaagcattattataagctctgacagaatgagtactaggtttactctctgtctccattcttgatcaccagcttgaaagaggtcagttcatcatcaacccagaagtggagtgaagtatgtctcacaattagcatgcacgctacttttatggcattattgaatatatctgcagacaaatgtatttggtcccagaaaatcaagcctcatagtggctgtgcctctctctgagtatcaatatctattcatgtacctaaatctatgtgtacaaaacacttaaatataatcagaatgtccaaatcaaacacctgttgcaaaaatgttatatcattcatgcagagagaagaatagaatgagaatatctatctaggttcattttggcacttggtcatttgactcattttcatggacagaatgtagtacactggggtatggtataatagttaatagttgaggctctcaagtaagacagattgtggcttgaaactgcctctgccaactgttcagcaggatgatcttgggctagttatttaacctcatagtcacagtttccccatttgtaatatggggatgacagaaataccttcctcatgaagattaccataaggcttaaatgagataatggaacatgagatgaatgaaaatggcagagcctggaacatagtacgtgatgagtaaatatcagctgttattcacagtattttttgtgatacagccttaaaaaaagagccaaggcaataaacactaatgaatcaattaccttagcaactttaatataggttagtaaaaaagaaatgtcatttactttatgtataatctaagtgagtgaatcaaaacttagctatatcttacctatattgtaattttaatatttttcaggtaacatatggtacatatagtttttatatatattataaaactgtaagaattaataactaaattattattaaataatttaaaaattaagtaatttaaaaattaaataattaaaactgtaagaattagtttaaaatgagcaactgtactaattataattctttcaagatttttttaatcatcaagaaacaataccagaactatgctgtcaggagtatattcatattttccatttttgcttatatttagatttgattgctcatttaaaatttggatattacctactacttggtatttggacataaagtgaaacagaaatgcacttaatatttaaattttatagaactaaaacaatttaaacaaaatatgcaatgcagtttatgtgaagcaaaacagttatatagatcaatggaggcacttcctgtgcatttgtaaatgaaaaaaacttgaaagatgtttttaaaccaccagaatatgaaaaaaaaatctctcttttttttttggtcttataacacaggtaggggaaataagcttgcaggtggaaatacataggaaaaatgtcattaaaaaaaaaaaagtcctcaatggtaaagtgaagaggccggatgtaatggccttgaaggttttatccatctgttaaggctttttattctatctagtgttgtctcagcttaaagggaatatataaaaagcaactgacattaacactaactcttcccaacgttactcagattgcctgcaacaggctatagaaaaagaagatgcagaggtgaggcaggaaagggcagctgtaaaaccccaatttttcttttattgttctttgctttgtatgattactccacacgctttaagtattgttatgtcaaactaaagtcgctgaaaaataatcttttgctgggaattctttaaaaattttttgttctcttttaaaccttatttataaaggtttccagatgcttatcctcacacattaaacccagtatgatgtagacacatacaataatattcactgctatgaagccaagaaaaaactacttgaagatctaactgcctatcactgaaagaatcggggtccagagaattttctggtgctattaagggtgtgattctctgaagtcatttggaaacaacctagtttctcagcagcaacacatctatcctgtactgtgtcaaagcacatcaaatggttggcattccaagcatcgaacaggttatttctcattatgcgaatacataatgaaaggatgtgggcaaagaacagaatgcaaattggaagctgacttctgactttaacagccagcagtgctgggctcaaacagtcattctaatttcaagagacaattccaaagtggttctcaagagaaaggacagagtatttttaaaatatttgttcaatgtgaatggattgggcttgccaaaaatgactttttatgctggcatgcgatctcttagagggaagtcagcctgagtcactggatacatcaaaggtagagtccagtgaatggaattactgcaggctgtgtgaacaagccagatacccgcattcatctgcccactgctgggatttcagccctccttttaattacattaaagcagctggtaccactggttactgaagtcttcagattaccttgattgcttggtcattatctctaatcagctgcttcttctcatcttcaaacttttgtctaacatcctggagccgcctttctgcagcaagctgctgctggctgttctcttctttcagagaggaaatggttgtctgaagttctgctatgatctaaaatgaaaacagcatgctataacttcaaattcttctgggagaggcatctattttatatgtattgatgcttaacaaaagaatggatttgacaaaactctattccacaaattaaatattttcaattaacatatcacacactataatgcatgaaataccacacaataaaagactttaataaaaatgtgaatggtgaacaactgctgaaccaaatatacttggaagacgtttccactctaacattccacaatatttactcatcagaagaaagaacatctgtgatctcaaaaatatgaaaagtgtcagattttattttactgagaaatatacttattagaatgagaaaagctattctgcttttcataatactttgaactgtaataaccaaagaaaataatgaacagagtttattcttcagtcacctaattctatacagtaatttttgggaattcactaatgtttgtgtattgtgtttaacactttaagttcttatgtcatttactactgtgaaacaggtattattattgccttttatttttttttttaattttaattttttttgagatggagtttcgttcttgttgcccaggctggagtgcaatggcgtgatcttggctcactgagacctccacttcctgggttcaagtgattctcctgcttcagcctcccgagtagctgggattacaggtgcccgtcacgatgcccagctaattttttgtatttttagtagagatggggtttcataatgttgatcaggctggtctcgaactcctgacctcaggtgatccacccacctcggcatcccaaagtgttgggattacaggcgtgagccactgtgcccggcctgcctatcttttataaatgaggaaacagaggcacagaaagaggacaaataccttacgttgttgaaaatgacatccaactaaagagacaggcaggatttgaaccatgcagtcagaccaatcactgcactaattgggtcctttaacctgccgactttatgggtttttttgtgttttttgtttgtttgtttgtttgtttgtttgtttgttttgagacggagtcttgctctgttacccaggctggagtgcagtggtgcaatctcggctcaatgtaacctccacctcccgggttcaagtgattctcctgcctcagcctcctgagtagctgggactacaggccaccaggcctggctaatttttgtatttttagtagagacgagtttcaccatattggccagactggtctcgaattcctgaccttgtgatctgcccgccttggcctcccaaagtgctgggattacaggcgtgagccaccatgcttggccactccgttatgtttctttaaaacaaggttttggtattgcagggaagtttatacttccaaataggttgtcctcttcctaactcatggatagttattttggtttacatggtgccattttcattcactcctgtagtattccctgcatttaagaatctgttctctccagacagcgttcttctaacttctcaaattaaccatctgatgagaaacttttatatttaattggccttatgagagcactgtccttcctttggtttggatgtatccatttccttgcaaattcaatagtgatgactttttaaaagcaggaaatagttgtttcttctaataaaagaaacaacattagacccacgttagaatataattcttttggtcctaagcagaggggagggcagttggtgagaaactctggacaagttatctttcttgaagctcagtttttccaactattatttggtgacaaaacaagattacagcattataaggcaataaatagaaactgtctggagtcccccagaggccaaatgctatagaaatactagttgttactactgacataaataatagcatcttgacaataaaatatggagtatttatgctttgagaagtgagcaaattcactataccaaagtttgacacttggaatttgtcaataatcaaatatttagccgattgtgaaatgacaaaatatataataacaacatgtcaatattattacatgcaaacttcagccttctgctatgagtggaggcattcatttactgagaatgaagatgttttcatccattttctgaattttgattaaatattgtttccattctggcatcaattcaattaattctcatagcacttctgtgaaacaggaaaggttaaattctcatagtaaatgtcaaaaattgatgcagagaacaatcaactcacagtcacagagccagaggagccagggataaaaaagagtcagatttccttggcctaatatgaaatttaagattgatcttttatgagaacatggggccaaatagtaaaaaacaacttactatttcaatgttttaagctgagtaaactataactttgtagaagtgggtttaattctggagagagaaggagggcaaggcagagaatgacagagagagggtgcgtgtgtgtgtgtttagttctgcgcagtttaacacatgtatagattcatatatccacaactgcagtcatgtgatatatttttaaagtacaaagtaattttttctttaaaaaatactaagattgagactagcttgtaactgaccaaagaataaagataaaaatatcctgggatacttcaaacggtcaaaggccatggaacagggacatttctcattttcagaacatttaggacaaaataattcaggttttgaggcggccggatcacctgaagccaggagttcgagaccagcctggccaacatggcgaaaccccgtctcttctaaaaatacaaaaaattagctgggtgtggtgacacatgcctgtaatcccagctactagggaggctgaggctggagaatcacttgaacccgggaggcggaggccgcagtgagccaagattgcgccatttcactccagcctgggcaacaagggtaaaactccatctcaaaaaaaaaaaaaaaaaaaaaaagaaaagaaaagaaaaaaatgcaggttttggaaaggactacaagtgaagtccaggatgttctaagaaggacgtgcttgcttttgtgtggaaaataaaaccttacattctttgggggaataaggagagattcctctggggaaaataatgagattatttttggaaagatatttttaaaacttaggaaggcgatataaggggcagaatgttaaaacacttcaggtgaaacacttggctagataaatagataaattatttggttaaaagactcacaggtgatacggatatggaacagtaactaaaataaggataattaaaaaaacaagatttaatactttaagattgagaaataatcataataatcagattaacatgcttcaggtaaggaacaaaactctactggttgtagacccagagtataagaaaatggactactttctccttagctcagtgtatgtaataactggcacccagtttaagtggtagaactataatcatggtaagtaataaaaagccatcacctggcaaattgaattcagataacctacccttctcatagaataataatgttaaaagtttctaagaaaaatgaaagctaatatatacaatcataatcaaaaccctccagttttgattgaatcataattaaaaaccatagaacaaaatgctagcactcaactaaatgtttatactgtattagtttcaatgaaagaagcagattagagaattttcatatggatattaaaaattagtattttcagaaacaaaaaggagagctattttgagctgatggtgtaagcatccgaactcatgaaagtcataatagttaataataattgttaagcaattaacgctttgcaaaaatgttagtggtcttaaaaaaaaaacaaaaacaggatcctaaataggggttaggatttcatcttcaactcattctattgcttttcagtttgtagtacagtttgagacttttataaaactcttctttaaaatataatacaataaagaagacaagctacttaagaagccatgcttaggaacgttaggtgaacactgacgctcctcacaaaataagtggatgccttgtgcattctgggttggcccccaggaggctggcatagagatgggcacaggggtcatgtggaatattcccaggtactaatatgcatcaggcattgggtagtgtgggacagtggtaggagacactcgtcccttggcagcaggcaagctcaactgacattccaacttcagtcctgcccatgtttctaactatggacattctggcaaaatggcagtatctttccttgaaaaatggccactaggtgactaggctgagtggggaaaactatattaatattgaagaggcaaggttaatacataatcacttattatttcaatgttttaagcggactaaactccagcactcaccaccactgcagtgtatgcatcgtctccattcttttcttaagataaaaaaaaatgtgattctgatggaaatgatatttgggggcgtgcccagagatgatgcaaacactgcagtggtggcgagggtgagtgctgcagatctcagaacggggcacaggtctcaggtgtgccaaagtttcagtgtacacggtctattaggtcctacaggcttgataaaatcatgaaaagtaagcagcttcctctaaaggaggaaaatctttaaaatattttccaaatttaatcttatgctctctgaggtaccaacacattcattactaatgcattcattttctttttttcagagagggatttttaaaaacccaacagagttaagcactttgcttttagtgttctcatcagcctaatgagatatgagttagagattccaacaaactatcacttaaatatggagagatccaatccacagtcttgttttataatgctcatttttaaataatctgacatgcttctctgaactgactggcattgtagactaatgcttctcaaatgccagttcacagatataaatatttagaagttggcaaacaaaatattatcaatgtaaggttatcatcctaacttttatgagaaggatggactatctttgattatattacatcctttctaagaattttttggtgttgcgctgtcccttgattaatgaaatgatggtaatagtatatgatagttgttactagttgctttttccttctccaccttcaagtcttttcttgggaaaacagttagcaaccctgtgcctctccaagcttttcagggagattttatcaccttgtgaacacccaaaaacatggtgtctgaagcaataatttgttccaccttccaaaccttttttcattcttccctgcctcctttcctctttctctatggcaattttagtgctgatactataataattcacattcgttaagtgctttagtgtgtactaggtactatactgaacacatttttggcattgttttacttaatagttaaaaccatcctatgaggttagtactgctcctccatttgacaaatgaggaaattgaattccaaagagggcgggtaacttgctcaaggtcacggaagtggtagggctggtattcaaatccaggggtgctggactccagagctcaggctttcttctgcattaacttacatttaatttgttttaacatcaactaatcaggcttcttcatacattcctttagataaatactcctgtttacactctcattatttaggcatttttattagctatcttatatctcactctcggtctgcttcccccatttaacgtaaagcgaaataagcaggatgttaggatatgccaactggggatttttaatgttttaatttaaactttaacttttggcctaaatagatttcttttgattgcaagaatctttttcagtggattaaaaggatatttctccatgttccttcctcaaggaagggctggaataatggcaatcaagacataatcatcatttcttacataaacatatacgactcttcatttggacaaagactttttgcttttctaatgggatgtgaattagtagaactgaaattttaggccaggtgcggtggctcatgcctgtaatcccagcattttgggaggatgaggagggaggatcacctgaggtcaggagttcaagaccagcctgaccaatatggtgaaaccctgtctctactaaaaatacaaaaaattagctgggcgtggtggcgggcacctgtagtcccagctactcgggaggctgaggcaggagaatggcgtgaatcagggaggtggagcttgcagtgagccgagattgcaccactgcactccagcctgggcaacagagcgaggctctgtctcaaaaaaaaataaataaataaaataaaataaaataaaaggaagggattgggccaggctggtagtgttaaggttaagaacttccactttgaagtcagatccagactgggtcctggctgagtcacttgccaacttgtgtgatcttatctctctaaatctcagttttcgcaaatggaaaaatggcaccagtaatagttcctaattccagagttattgtgaaagactgaatgagtcaacatggttagtgccccatgaacattagatattattatctttttgttgttgttgttactactattatgtggcattatgtggtagtatggtaaattctagtttactaaccaaataccactgtatatatatataaaaatatgaagacaagctgattttaacaatcattagatatgctcacaaaaccaaatggcttaacttacctacctgcaaagtaaagataagtagtatttatttgttctagaatcacttatacaagtaaggaatacttggagttccttaaatgatactactggatatcactataataacttatgctgaaaaagtactctgagcatcatatttcaaatagagacaggcattcaattattggcctttcttatactaaaactacaacagtaagtacaaatagcaagttatggatgtagggacttagaattctctttgtcctaaaaagagtcaacagttgagccgcagacttaacctagaattatttgtcattttgaattttgtttgaagaagcctttggtagagcaaaatggagtattaccaaaaaagcacagatagtaccaaactgcttacatcacaaatgtaggtgtgtatctcctgtccttgtgaagtatgtttcagcctgggcttgttcaagtgtataggctggttttacaacatctgagagtgtgtgtatgtgtgtgtgtgtgcatgtgtgtgttgtttcaaatggttaaatatgcctaatttttcttgatttttaatgactgaaatattaaaaccatattgtttatttgtatacccataaaaatatgataccattccacaaaaaaaaactgaaaagaatgaagtttaacttgaaagtgccaaggcttttatgtggaggtttcatttttgttttggttttaccctgttttgtgtcttttaatgttgcttacctgtgaagatttggcaagcttctgagtgtattccttctcaatctgcttcagcttgctgttggcctgaaaaacacatgtacatgaacacatacacagtgacctgtgagcttggtatctcttccacatgcctatcaccaggcagctgggatgcctgccagctgcaccgcccttctggggcagccagaaaaccacagggcttgtctttgatgttacgccaactattcatcacttaaaaagcaaaaaaaaaaaaaagatctcttctgccaattattagacaaacataagacttctgtggatagaaagagaaagggagaaagagagacagaaatagacacagcaaaagtatgaaggctcagaaggtaaagtaagggaaagagagaagaaacaagaggggcaaggaaaagggagagggaagtgaaggaagaagaaaggaaggtaaatttaatactttttcaccttaattaaaaaaataaaaggaatagatgcttctggacaaaggagatatgggattttgagaatcactgagcagaggtgagcccctactctgccaaatacataagagctaatttttacagtgacaaatgtatctaaatcaaacaagttttaagttttatgtcctggaaatagggtggcctttccacaatcagtccacattgcttagaacttggttatcccctctgccactcaagttccaattctttttatgtgatctgttttctgctctctggaaacttttgggatctttatttcatcgtcaaggtttaaaaatgtcacagtgacgtgccctagactgtgtcttttccccatcaatcatgcgggcactaaagaggctctttcactctgaacttgtgtcctttactactgggaaaggctggtcattactctcatgatttctctcgtctctctgtacgtctgtttctctccctgagtatgtctctccctgcaactctgattttgtacctcttagatttagtgtctctttttcttgttgtttctatgttccatttgtctttttgattattcttagaatttcctcaacttttacctaaaactttatattctgccatcatattcataattcccaacagttcctttttgttctttgaacagcatcatcattaacatccctctttttacagatgagaaaacgaagacacagagagggtaagtaacttgcccagcatcacacagctaggaagtgatgaagccaggacacaaactcacactttggctgcagagcacaggtgctccaccagtgagagcactgcgtcatgccttgcaatacagtccttctatctatctatctatctatctatctatctatctatctatctatctatctactgttcctttcatccatccatccatccatccatccatccatccatccatccatccatccatcatctgtctatatgtctataactatctatctacacatatattttaatttttttctgctcagtagagtgtgtgtgtgtgtttctgagttccctttgtttatttactttcacctgtctgttttggtctttgtctttcactttagatactttcctcaaatatctggtgatctttgatgtcctttcttattcaaagtgaggtctccaaagctggatagaagaatcttgcatatatgtatgggtttgtggatgggtgggcatcactgcagggtgtgttacaaaggggcctggactctcccatgccagcatctgactggatttccctcttggatcagtttgcccagagctgcatcctccagtttcctgccaggcagcacaaatctgatggccagtattttcagaagggcatcaaggtgttcaggagagtgactctcgtgcaaggctagcctcacatttctcctcaactgtacctgaggccctttctcattccacctctccagagaacaaaccagggatagggatgggggcagtcttgggataaaatctgggccatctgtcccaaatgcagactttcaaccaatcttccagttcttcacttcaccccatacccagtctctccaattcctgaaccttcccaaagttctaccacaggaaagatcttgctgcttctaatgggtatccttcaggtcttccttcccccagaaattgttcagtttttaggattattagttctgctaagttaatttcaggcccagcctttttcaagttctcaatgctattgatttcttatgtgtatggttgtctcttattttctttgaaaaaatatatagtataaaaatcttgatgcctgagtctcatctgcagaggttctgattcaatttatctgggctacaggctggacactaggatttttaaaaatctctgctgctatttcaaaagttcagccaaggttaaaaaccactggttcatgcctttttcaatttccttactttcattttgatgggacttcctcagggagtagagataaaaacaggtgagttctgtccactacctttagttggaagcaaatgatttgtttattttcatatcacaaatagggtgaggaagcaatcccgtgctcacagcccactccaggctcacctctatggtagtactaaggctgaattagtcattgttggttaacctgtctttttcccactagataatgagatcctagaaggcagctcctagcccctaacatagtgtttggggcataattgtccatctaatgaatgagtggatgccgtacaagccctttgcctcttctatcgcctcagtccatacctttgaagttttcttttcataaccatttttttacggacttaagttcaaaaccaattctttagagttcattccataaatctctttgtatctataatcccatcgagtacacagggtagttctgtttcttccagaatagagagggcatgtgactattgctatttttctagtaagtcatcagacttgactccagctctattatgattaaagccactctccaccagaattagggctactctgaacctcttgaggtttatttgtcttggctcacattctgtcactatttttttttgtcacaaaatgcttaataaagtatttgttgcttttaaaataaacgcttaatagaactcataccatgtcccaggcactgttctaagtgctttaaaaatattcacccactagaaaatctaaaaattaattctagtgtcataaagatgaggttacttttccctaaaaatgctagagtcacggataatagttagtgcaggaaggcctgtgtcttggtgtgagctactcttcatgagtttatggccagcccccaaatctcacaaacccaatgaagctcctttataactaaatatccaattcattcatccactctaggcagctggacagcagcaatgaacaaaacagccaagaatctctctccatttttatgaaacatctagagagtaaacaaagtaactttgaaaagttacatggtgcaaggcctatggagaagtatcaatcaagaaagagagagaggaagtgataaaagttagggggtactttataattttaaaaatactgaagtaacagatggcctccctgagagggtgacgtatgaacaaagacctgtaggagatgagggtaacctctagggaaacagcattccaggcagaaggaagaacccatgcaaaggccctgaggcagaggcatgcacagcatgttcaagacacagtatggaggccaagagcagtggctcacacctgtaatccagcactttgggaggctgaggctggcagatcactttaggccaggagttcgagaccagcctggccaaaatggtgaaaccctgtccctacaaaaaatacaaaaattagccaggtgtggtggtgcatgcctgtaatcccagctacttgggagggtgaagcaagagaatcatttgaactgggaggcggaggttgcagtgagctgagatcgtgccactgtgctgcagcctgggcaacacaagcttctgtcgcaaaaaataaaataaaataaaataagataaaataaaataaaatacaatacagtgtagaggtcagtgtggttggatcagtgcaaccagtggagcactggctccttcagacaacacagggctgtgagagaaccaggtcctgcacggtgttgaacgtgattgtaaggaattcggcttttaagatcactgaaacagagccactgaaggggtttgtgttagtccattcctgcactgctacaaaccaaacactgcatgttcttacttgtaagtgggagctgaacggtgagaacacatggacacatgggggcgggacccactggagcctgttgggggttgcggggagggagagcatcaggaagaatagctaatgcgtgctgggcttgatacctaggtatgggttggtctgtgcagcaaaccaccatggcacacgtttactatgtaactaaactgcacatcctgtacatgtagcccagaacttaaaataaaagttgaaaaagaaaaaaaaatacaaataaaaataataaaaagagaaatacccaagtctgggttaatttataaacaaaagaggcttaatttgctcatggttctgcagggtgtacgggaagcatggctggggaggtcccaggtaacctgcaatcgcagtggaagttgaaggggaaacatgcatatcttcacatgcccagagcaggagaaagagaggtggagaggtaatacacactttcaaacaaccagattgcatgacaactcactcactgttataagaacagcaccaagggggaaatctgcccctatgatccaaccacttcccaccaggccccacatccaacactggggattacaatttgacctgagatttgggcggggacacacacccaaaccatttcagggtttcagtataggagaaatatatcctttgacataggttttaataaggccactccagcttttgtttggggcaagaatgaagcaagtaagacagttaggagggtactgcaaataatctaggatggcaatagaggaggtggtgagaaggggtcagattggagaaaaattagaaagtagaaccaactggacataccgtataatggaaagagatgagtcaaggatgacttcaagatttttgtcctaagcaactagatgaatgaggttgtcattacctaacatgggaaaagttacaggtgaaatagggtttgcagagaagtttaataagtttgtacttattaaacttggagatgcctattaaatgtgcagtattgaagtatctgggtattcaagtcttgagtttatggtttaaggtctaggttaaaactatgaattcagaagtcatcagtttatatagggtgtgtgaaaccatgctactggatgagatcccaagatatccagtgtatatactggatgagatcccaagtatacacaagaaagcagaggtctaagtatactcagccctgggcctgcaaatgttaggaggctgggacatgaggaggaaacagacagaagtaatagccacagagtcaagaaatcaggataggctggtggctcatgcctgtaatcccagcactctgggaggccaaggcaggtggatcacctgaggtcaggagttcgagaccagcctgaccaacatggtgaaaccccatctctactaaaaatacaaaaaaattagctgggcgtggtggcggaagcctgtaatcccagcgacttgggaggctgaggcagaataatcactggaacctgggaagtggaggttgcagcgagctgagatcgtgccattgcactccagcctgtgtgatgcagcaagactccgtctcaaaaaaaaaaaaaaaaaaaaaaaaaaaagaaatcaggataatacggaatcttgagccaactgaagaaaagtgtttcaaggactactcagttgtgtcaaatgctacagagaggccatagaaagtgaggcctgagaattgatcacagtagtttggcaacatggaggtcactggtgataaggataaaagaaattttgttgtagtgggagacatgaaatctggattaaaggaaattcagagaggagaggcattggaatttgttcagaattttattaaaagggaaggtgagaaatgagatggaagctgcccaagaagcgggtgaatagagaggtgaattgttttgttttttggtaagttgaggaaattaacagcatgtttgtaggctgataggaaagatctagcagtagagagggaggaaaaaaaccagatgatgccagagctttcctagagacatgtccttgagttaaggggagggctatgtcatggagtgaactgtgtcctccccaaattcctatgttatgttgcaaccctaaaccccaatttgactgtatttggagatagggcctttggtgaggtaattaaggcaaaatgaggtcataagggtggggccctactccaacaggataggtgtcattataagaagaggaagagacacccatctttctctgcctgtctctctgtatgcacacacaggaaaggaaacagcaagaatgtagcaagaggcctcaggaaagcaatcctgataccaccttgatcttgggcttctagcttccagagctgtgagagaatgaatttctatggtttaagccacccagtctgtggtgttctgttatggcagcccaagccagctactacagggtgggacgaggggaggagatggcctctgctggaagtgcaggcaaatgatcccccaggaacaatgatgggagcttctgattgctctcattatctctgcaaagtaggaagaaagattcatcagctgagcatgaggatggtagaaaacatctttgggaaatttcagaagtgaaggaaggcataaaatagtcatctaaaaaaagcaggaaagggaaaagacagagaaatccagtatgagtcccaggactccaggaagcatcaggacccacttgaaattgccaatgctgaatttaaaatgaggccagtctgtacagaagcacttctggaatttgctaacagctaaatagagtagaatcaatactttagagaatacgagtaaccaaaggaataaaattaactgatcaacttttgtggtttttactattaatattttcttcagtgtaaatcatagctgcctgaattcctgaacccctcttatataaatctaaaaagctctggtttatcatggttgaaaattcatggctaacttatcaggcaaactgtccctaaagcattttttgaatagctttagtatcaagatggtactgagtgtacatttcatttccctgcttaaaggaaggcttagttattttaaaccaagtcttatttttatagctatcatttgtatatagaaacacaatttttaaacaactaccagcagcataacttgaacaaatatataacagaagaggagggaaccacaatttgggaaccacatagtgagacagggtctcactatgttgctcaggctggactcaaactcctaggctcaaaggatccctcagcatcgcaagtagctgggattacaggtacatgacactgcccttggctctgctctatttttattatttcctttcttctgctacttctgcaaagtagtagtagaaatagtagtagtcatagtagtagtagtggtcgttgttttcatctttggttctttctgactgttgccatttctgattggttgtgcccgtcctcctccagacagtattcagttctcatctgtttttctagggctgcttcctcagatcattctccttattaaagagcccaatgtattggttcacttttaattcctaacaaaagcttgggtttaaaactcaattagaaagggggaaaaatacgaccaatttacaaaagtgtccatggttgtaattatcttaatgtgctacccttttctttgcattatgcctcaatttttaaaaagtccttcattccttcattttccatttcctatcattaatggtgaaggttcaggcattcatgatttccaggaaagtgatttggagagaagaaaattaggagatttgtctaaaatatttatatttaaggcaagcccagatcttactatgatagctttaaaatataatagctatgtctttaaaatcttcaaatatctttaaaatataatagcataagtttctgaataaaatagttgttttaggctgaaagaaagcaagaatgcttcccagatcctagaaacatggcataaagctcagataattatgcactactactttctattcaaaagctttgtaggcatctatttgaaccttcttggaacactattgtcagaggcgtatgaaccagagcaactccatcttgaataggggatgggtaaaatgaggcggagacctactgagctacattcccaggaggttaaggcagtcgaagtcacagaatgagagaggaggtaggcacaagatacaggtcatacagaccttgctgataaaacaagttgcagtaaagaagccagccaaaacccaccaaaaccaagatggtgataagagtgacctctggtcgtccttgctgctacactcccactggcaccctgacagtttacaaatgccaaggcaatgccaggaagttaccctatattgtctaaaaaggggaggcatgaataatccaccccttgtttagcatgtaatcaagaaataaccataaaagtgggcaaccagcaaccctaggggctgctctgtctatggagtaaccattcttttattcttctatttccttgataaatttgcttttactttgcggactcaaccctgaattctttcttgcgcgagatccaagaaccctctcttggggtctggatggagtcccctttcatgtaacactatgaatccagttatggccagcctggtaaaactccgcaccatcctaccagcaaaaatatttagaaaatttataacaaatatttgtatttaattttaaatatttacaaaacattcaaacttgaaaataatctgtattttacttcaaaataaatgtgcaaatttgtaaaacagtaaaattcatgactgctgccctggctgtgatgaagtaactgccacagtaaacaatgagaaaactggacaaaacaaaggagaaactgttttaggatatcaggcaacaggaagcagaggattgtgacccaaagagaagggaaacaaatgaggtaagcgctcatttagttgttctttgatttatttaattcttctctgattctttcatcagaattctgtagatttcatcatataaatctcatacatacagatggttcttgacacgcaatggcatttcaccccgataaatctgttgtaagtacaaagtatcttaagtagaagatgcatttaatacctcgataaacccattgtaaagtcaaaaaaatcatgaagttgaacctttgtaagtcagggacagttattatagacgtatacctaagtagttaattttgggggtactaatgtaaatagtattgtgtttttggtttaaaattccacttattcattgctggtataaatgaaagcagttgatttttatttattaaccttgcatcctgtaaacttgctataatcacttatcagttccaagagtttgtcgattcttttggattctctatatagacaatcacatcatctgcaaacaaagagagttctatttcttcctttccaatctgtatacctcttatttccttttcttgtgtattgcattaactaagatttctttgatgttaaaaaggagtggtgagaggggaatcacaatcaatgccctgtttctgatcttagagagaaagcttctactttctcaccatgaagttcaatgttagctgtaggttttttgtagatgttctttatcaagttgaggaagttcacctctattcctagtttgctgagattttttttcatgagtggctgctgaattttatcaaatgatttttctgcatctattaatatgatcatatgatcacacagatgcgattgattacattcgctgattttcaaatgttgagacagccctgcataactgggatacattccacttggctctggtatataattctttttgtacattgttagatcagtttgctaatattttgttaaagattttttcatttatgttaatggaatataatggttaatagattttttttcttataatgcttctgtctggttttggtatcagggtaatgctgacctcacaggatgagttaggaattatttcctctgtttttatcttttgaaagagattgtagaggattggtataatttcttccttaaaagtttggcagaatttaccattgaatccatgtaggcctggtgtattctgttttggaaaaggagggtcattaattattgattcgattgccttaatatatatatccattcagattatctttttctgcctgtgcgagttttggcagattgtgtttttggcagattgtgtctaggttatcaaatctataagcatataattgatcatagtatttatttataatccttacaatactcgtgggctctttagtgatacctcatttttcattacttttattagatatttatattctttttctttttttcttagtttgcatggctaaaacctatcaaatctattgatcttttcaaagaaccagcttttggtttcattgattttctctattgatttcctgttttcaagttcattgatttctgctctaattcttttaaactttttttaaattatttttatttttatttttaaagacagggtctcactatgttgctcaggctggattcaaactcctaggcacaaggaatccctcagcatcccaagtagctaggattacaggtacatgacactgcctttggctctgccctatttttattatttcctttcttctgctactttggatttaatttgctcttctttttcttgtttcccaaatgaaagcttaggctattgattttagatatttcttcttgtctcataaatgcattctatgttataaatttctctttaatcactgctttctccctatcacataaattttggtaagttctggtttcatttagtccaaaatatttttaaatttatattgagatttcttctttgacccgtgtgatttttaaagtgtgttatataatcccaaagtatttggggatttccacctatctttctgttgatttctagtttagttccattgtggtctgagatcagatattgtatgatttctactcttttaaatttgttaagatacgttttatggcccagaatgtagtctatctaggggaatggtccatgtgaggttgcaaagaatgtgtatgccgctgctgttggatgaagtagtccaagatatccattatttccagttgattgatggtgttgttgaattcaactatgtccttactgatttttctgcctgctggatctgtccatttatgatagtgggtattaaagtctacaactataatagtagattcatctatttctccttgaagttctatcagtttttgcctcacatagtttttgtttgttcgtttttggtttttttgcctcacgtattttgatgttctgttaggtacatatacacctgttaaggattgatatgtcttcctggataattaaaccctttatcattatgtaatggctaccatatccctgataattttttgtcctaaagtccactgtatctgaatttaatataactactaattctttcttctgcttagtgttagtatggtatatattttttttgatccatttactttaaacctatatatgtcttatatttaaagcaggtttcttggagacaatatatagttgggtcttattttttgatccactctgacaatctctgccttttaattggtatgtttaggccattgacatccaaagtgattacttgatatagttagatcatagctaccatatttgctactactttctattcattgtcctggttcagttttcctatttttgtcttacactgtttttcctgcattttgtgggttttaattgagcatattccattttctctccatgcttcttttttaaaacatattttttactggttgccctagagtttataatatatatttataaataatccaattccactttcaaataacactatatcatctcatggatagtgggagtaccttatatgaatgaaataatcctaatttactccttgttattttttgtattactgctgtcattcatttcacatatatgtaagcttatgtaagtatatatgtctgtataaatatatatgaatattgttgctgttaatattttgaataaactgctgttaggtcaattatgaagaaaaataaaagttttaattttatcttcacttattcattctctgatgctctatgtagatcaaagtttcttacctatatcattttcattttatctaaaaacttctttttaacatttcttgtgaggcaggtctactggcaacaaactcccccaatttttgtttgtctgagaaagtatttctcctccatttttgaagaataatttttcgaggtacagaattctagattcgtagaggtgttttctctcaacacttgagattgttcacttctctctcttcacgcttgcatgatttcttagaaaactgatgtaattctcacctctcctttttatacgtaaggtgtttttcttttccctctggcagatttcaatactttttaaacattttttattttctgcattttgaatatggtatgcctaggtgtgtagcatgttttttctttcatttatgctgattggtgttttctgagcttacagatctgtggtttggtgtctgacattaatttggggaaattttcagtctttatttcattaaatatttcttctgttcctttctctctttcttccccttcctttattcccatatgtgtacattacaccttttgtagatgtctcaactacaaaagatattttattgttttttttcagtctttttttttctctttgttttacaactttggaagtttctactgagatatcctcaagctcagatattctttcttcagctgtgtccagtctactgatgagtctatcacagtcttcatttctgttagggtttttgatctctagcatttctttttcattctttcttagaatttccatctctctgcttacactgcccatctcttcttgcatgccatctactttatccattaaaacccttagcacattaatcgtagctgttttaaattcctggtctgataattttaagatctctgtcatatatgagtctggttctgatgcttgctctgtctcttcaagctgtgttttttgccttttttgtatgccttgtaatttttttttccttatagctggacatgatgtattgggtatatggaactgcagtgaaaaaggctttaatcatgtggtggtaacgtgttagggaagaggaagtattctacagtcctataactaggtcagtcttttagtaagcctgtgcctctgggctgtaaatgtcactgtgcttctcagtttctccccctcctagctcaaccaggatggttcaagaatggagggatctggacttgtgtattttccatcccccatatagaaggctagagttggctgtaggtggttatctcccttcccccagattggttaggctctgaaaaatccccaataatttaggtgcttgtaaaaccatttttcttggtattttgttgctgttggatacaaagttatatatagcccattttgtctaaagcacaattcaatgtcagtatttcccttttaattttctgtctcattatcggtctgttgttgatgggggatattgaagtccccactattactgtattgctatctatttctcccttcatgtccattaatatttgctttatatatttaggtgctctaatgtctaatgtctaatgtgctctaatgtctaatatatatttacacttgttatatcctcttgatgaatgtcctctttatcattagtgactttttttgtctcttatgaaagtttttgacttgatgtctattttaaatctaaatatggccacttctgttctctttttttttttaccatttgtgtgcaatagcttcttccatcccttcactttcagcctatgtatatccttaaggctaatgtgggtctctcataggaagcatataattggatcttgattttttattcattaaactactctgtgtctttggattggaaaatttaatccatttgtaattattgacgtttaaggacttactactgctatgctgtttattgtctcctggttgttttgtatatcctttgttccttttttcctttcttatttgccttcatgatttggtgatcttctatagtgttaggtgtttattcttttttctttatttttttgtgtatctgctatagtgttttgctttgtggttaccacaaggcttacgtaaaatgtcttatagttatataataattgactattttacactgataacaacttaattttttccacatacaaaaactctaaacatttatcctccaccctgcttgatctagtctgctgttgaagctctctattgcatttttaaatttcattcattgaattcttcaggtccaagatttctgttcggttcttcgttatgatacctatctctgttgaatttctcattcagatcataaactgattgatatcatcaaattgtctctctatattctcttgtaatttttttgagtttccttttcttattttgaattgctttacaaacaattcatacattttcttttctttggggtcagttactaaagaattattgtgttctttggtggtgtcatatttccttccttttttaggtgcttgtaaaacagtttttcttggtaggctctgttaagtgcaacaaagtgctctggtgtatttcacaatggtcacttttctccttcccctgccagaagcacaaatgatttttttctacaatattcatgacgagaacctggtcaagctcctgggggcaaaactcacaaaagcccaacactgctatggctgcttgcaagccatgttagacccaataccaagagagtttccctcagctaagactctccattgtggggaacatttaaacagaaggaccccaagagcctgtgctactgtgaactctcacaatatgttgctgccactgattccctaaactcttatagcctatggcactgaggtacccacagtcatctgtgatactgatcacagctgaagaagctgcatggaggcttgaccactgcatctatccagaagcagggccagcacacccttttcaaccagcacattaaggtctatctgcagatgaaaatattttcctatgaaagtaactctgtaaagtttggaagtggtgactgtttcatcagatgtgaagacaccaattcagaaacacaagaaacatgaaaaaggaaggaaatatgacaccaccaaagaacacaataattctttagtaactgaccccaaagaaaagaaaatgtatgaattgtttgtaaagcaattcaaaataagaaaaggaaactcaaaaaaattacaagagaatatagagagacaatttgatgatatcaatcagtttatgatctgaatgagaaattcaacagagataggtatcataacgaagaaccgaacagaaatcttggacctgaagaattcaatgaatgaaatttaaaaatgcaatagagagcttcaacagcagactagatcaagcagggtggaggataaatgtttagagtttttgtatgtggaaaaaattaagttgttatcagtgtaaaatagtcaattattatataactataagacattttacgtaagccttgtggtaaccacaaagcaaaacactatagcagatacacaaaaaaataaagaaaaaagaataaacacctaacactatagaagatcaccaaatcatgaaggcaaatcagaaaggaaaaaaggaacaaaggatatacaaaacaaccaggagacaataaacagcatagcagtagtaagtccttaaatgtcaataattacaaatggattaaattttccaatccaaagacacagagtagttcaatgaacaaaaaatcaagatccaattatatgcttcctatgagagacccacattagccttaaggatatacataggctgaaagtgaagggatggaagaagctattgcacgcaaatggtaaaaaaaaaaaaagagagaacagaagtggctatatttagatataaaatagacatcaagtcaaaaactttcataagagacaaaaaagtcactaatgataaagagggcattcatcaagaggatataacaagtgtaaatatatattagacattagagcacactagacattagccattagagcacctaaatatataaagcaaatattaatggacatgaagggagaaacagatagcaatacagtaatagtggggacttcaatatcccccatcaacaacagaccgataatgagacagaaaattaaaagggaaatactgacattgaattgtgctttagacaaaatgggctatatataactttctatccaacagcaacaaaatacacattctcctttagtgcacatggaacattctccagtacagactacatggtgggccataaaacaagtcttaaatttaagaagatcaaaatcatgtcaagtattatttctggccacaatggtataaaattagaaatcaataacagaattaactttggaaaattcacaaatatgtggaaattaaacaactggctctaaataatcaatggatcaaagaagaaatcaaaagaaaaactgaaaacgatcttgagacaaatgataatgaaaacacaacataccaaaacctatgggatgcccaaaagcataaatgtcccataagaggaaagtttatagcaacaaatgtctacatttaaaaagaagatcccaaatagcctaacattaagcctcacagaattagaaaatgaacaaattaaacccaaagttagcagaaggaaggaaattaataaatatcagaaaagaaatagagaatagaaaaaccacaggaaaaaaacaataaaactaagagttggtttttgaaaaaatgaacaaaattgataaactcttagttataccagcttaaaaaaagaaagagaagattcaaatatataaactcagatatgaaagtggagacattacaaaagatgttctcagaaacaaaatagatcataaggaactattattaacaattatatgtcaacatagttgatcatctagggtaaacagattaattcctaggaaaatataactgaagaaggttgaataagaaagaaatagcttgaacaggccaacaacaaatgaagagattgaagtagtaatttaaaatctccccaagaaagaaaagcccaaaaccagatgtcttcatggctgaattctaccaaactttcaaaaaagaattaataccaacacttcttaaatacttccaaaataaaaaagagctggataatacagctgacccttgaacgacatggaggttagtggtgctgaccaccccccaaatgcagtcaaaaatctgcatgtaacatttgactaccccaaaacttaactactaatagccaactgttgactggaagccttactgataacatgaacaatcaattaacacatattttatatattacatttatcctacactttatttttacagtaaagtaagctagggaaaacaaaatgttataaaaataataaagaagagaaaatatatttaatattcattaagtgggaagtggatcatcctaaaggtcttcatccgtgacatcttgatgttgagtaggctgagaagaaggaaaaggagttggtcttgctgtctcaggggtggcagaggcagaagaaaatctgcagataagtagacccatgcagttcaaacctgtgtcgttcaagggtcaacactacttcctaacacattttatgaggcagcattaccttgatacctaagccagaaaaagcaacataggaaaactataggccaacctctctgaagaacattgatgcaaaactcttcaataaaatattatcaaaccaaattcaacaacacatcaatacatcgtgattaagtgggttttacccctgacatgcaaggctggtttaatatacacaaatcaatcagtgtgatatatcacattaacaaaccacatgatcatatcagttgacaaaaaagcattcaatacagctcgatgtctgatttgataaaaacttttaacagtttagatacagaaggaaagttcttcaacataataaagcctatttgagtaaaacccacagctaacatcataatcaatggggagaaactgaaagctttttctctaagatctggtataaggtaaggatgccaactcttagcacttctacttagcagagtactggaggtgctatcaagaaccattagacagtaagaagaaataacaggtattcaagctggataaaaaagaagtaaaattatgtctatttgcagatgacatgattgtgtatgtgaaaaatcccaaagattgcacacaaaaacctattagatctaataaattaactccataaagttgcaagatataaaatcaatatataaaaatctgacatttctatacacaacaatgtagccaaaaaggaaactgagaaaacaacctcatttacaatcacatcaaaaaaataaaataggaataaatttaaccaaggagagacctgtacactgaaaactataaaacattaataaaagaaattgaagaggacacaaagaaataagatattccatgctcttggattggcagaattaatattttttaaatgtccatactactcccaaaggaatatatagatgcaatgcaaaccctatcaaaatttcaatgacagtcttcacagaaatagaaaaaaaaacctaaaattcataaggacccacaaaagaccccaaatagccaatgcaattctgagaaaaataaagttggaggcatcacaaatcctgatttaaaattgtattacaaagctgtggcaaccaaaattgtatggtactgatatagaaacagatgcctagactaatagaacagtatagagagcccagaaataaatccaaacatatatggccaactaattttcagcaagggcaacaagaaaacacagtgaggaaaagatagtttcttcgataaatagtgctgggaaaactgtatttctacatgtaaaagaataaaattggacccttatcttacgccatacataaaaatcaactgtctctccaaatttgggagcagcagttttccctgtgagtttacttctctgataaatataaaaaatgctgatcagtttttttcctgctttttacttgttgttaggatgaatggcaacttccaagcaccttacatgccagggcagaaactggaaattaagctaaaaataacattttaaatatccaaatggttcccagagagacaaggagtaagtttactgaataatctcagttatctctgagatagtatcacatcatctaacatatgtgtagttgtatcccagaaagagaaagaggtttggaaaaatatttgcagatggaatggctgaaaattttccaaaatgaaaaaaaaaacctctaagaccacaagtccaaaagatcatcaaacaaacaaacaaacaaaagatgagataaatacagagaaaaccatatcaaggcataacataataaaattgcaaagaaaagaaataaatataaaatcttataagaagccagagaaaacagatacattaaaaagacaggaatcaatgaagatttctcatctgaaaagtcagagaacaatacaatgaatctttaaagtgctgaaattaaaaaaaaaatctgttaatctagaaatgcatatccagtgaaactatccttccaaactgaaagtgaaaagcacacatattcaaagaaaaattggagagaatttgtcaccagtagatgtgcactacaaaaaaggttgaaataagtcgttcaggcagatggacctgatactaaatggaaacctggatgaaaccaagggaacaaatagtactggacataaaaaaagtgtgtaaatataaattactttttattctcacgttaaaatttctttaaaagacaattgaatatttaaagcaataataacaaattgcgaggtttataatacttgcagaaacatagaatatgaatgtggaaatggaagtatactgttaagaaacttacattttatatgatctggtacaacagtaggtgaagacagactgtaattaagatgtatataataaaacctagatcaacaactataaaaaccaacagtgaagaggtatagctaataagctaatagtagaaataaaataaaatgttaagaaataattaattcagccactgcactccagcctgggcaacagagcaagactccgtcttaaaaaaaaaaaaaaaagaaataattcaataaaaggtaggaaaagaggagaaagaaacaaatataaaagaaatagcaaaatggtatattaaaacctaacaatatcaataactatgttaaatataagtagcctaaaaattccaactaatcggcaaagcttatcactgtgtttttaaaaaaaagtttaactacatggtgctttcacgataaatgcttaaaaatcttttaaaaaaggttaagattaaaaggatgacaaaagatgtaccatgcaaacagtaatcataagaaaagtggagtcaacatatgaatatcaaacaaagtggattccagaacaaagaagctgctctgtatctctgtagagatacagaggggcatttcacaatgataaaaattgaattcatgaaaatgatctaacaatcctaaatatgtatgtacctaattttaagggcttcaaaatacatgaaacaaaacctgacagaaatgaaaggataaataggcaaattcacaaatgacaactgaagataattcaaaactcctttcacaggaagtgataggacaagtagaccgtattagtgaggatatagataattcaaaaactgctatcaacctacttgaccattaatcaagatagaccatattctgggccataaaataaatttcagtaaattaaaaaggattgatctcatacagactaaatgctctgaccataaagaaattaaattagaaatccataacagaaatttatcttaatttttgtaaagtaaaagatagacatatactaatattagagtcaaagaaagaatcatggctaggcatggtagctcatgtctataatcccagtgctttgggaggccaaggcaggagaattgcttgaggccagaagttcaagatgagcctgggcaacatagtgagaccccatgtctaagaaaaaaaataatttaaaaattagccaggtgtggtggtacatgtctgtattcctagctacttgggagttgggaggtgggagggttgcttgagcccaggagtttgagtttatagtgagctgtgatagtggcactgctctccagcctgggcaacacagcaagaccctgtccctgaaaaaaaaattgcaaaggaaattagaaaatatttggaaatgaatgaaaatggaagcatatacttatacaatgcagctaaatcagtacttagaggaaatttttagcttctgaattcttttattagcaaagaagggagttgaaaaataagtggtataagctttcaattgaagcaacctgaaaaagaatagcaaattaaagaccaagtaagcaaaagaaagaaaataaatataagagttgaaatcaatgaattagaaaagaggaaaacaatggagaaaaattaatgaaaccaaaagctggttctttaagaacaataaaattgataaatttctagatgtatagatctgaaaaagaagacacaaattaccaatatcagaaatagagacaggggacattactatcagattctgtagacattaatagggtaataagaaaatatgaacatcatatttacaaatgtttgataatttaaacaaaatggataaatctcttaagtgttagaaattactcaaagtgactcaagaattagaaaactcaaagacccctctatttattacacacacacacacacacacacacacacacacacacacacacagacagccccttctgaaaccctgatatacccctctgcactgtgttagttttgcaaacatttactttgaggaccttctccgggttaggcactgtatgtttacagaagtaaaagatttaatgcagttggggagggaagagacagatgagtgaataaataaaatactgcataataagtgtcatgaaagagatctgcacagggtgttattaaggaaaaaatatgagataccctacatgagagaagacttccataaggaggtgaatattaaagggtaatgatgataatgatgatgatgatgacaatgacaatgatagcaacaacaacaaaataactgtttacttttctcttgatctattgacacatattggctaaatgtgttacacatatgaatgaatctaaacctctcaaaaactctgcagtaggcactattatcctcactgaaaccgagagacccagcagataaagaacttgtctacggctatgcagccagggatgaaaacgaatcaagtgactgaaagagaagaaagtttcagatgacaggagtgacgtgcaaaggtacagacgcttgaggaagcatggtaggtagatttgaggctgcaagcttctttccttccttcacaggcacatttcttgaaaggtaatatctaccccctgccttcattttcgtttccttattagttcaagaaatatttactgagctccttggtgactacccagtctttccttgatgacctgaaatttgaccctgtcccttctattcaacttgccaacaacctttttactgctgtaataagaggccatttttttataatactcattttcttctgattataaaagtaaattcagattgtggtgatggtatacaattctgtaaatctgttaaaaatcattgaactggacacaaaacaagaatgtctccaaatgtaaattatacttcaataaagatgggtttttttaagtaaataaatgctcattgtagaaaaaccaagaaatagaaagaaatacatatggtgactatctcctgtaatctatcaccgcatgtagctagtgatttttcggtgcaatgtttttgcacattacctggatatttctgaagtcttaaacctgatattttcttctactcagccctgcccagcttgtcattctaccttccctgcctcgtgggaaagtatagaaaaagcaaaggaggttgggcacagtagctcacgactgtaatcccagtgctttgggaggacgaggcaggtggatcacctgaggtcaggagttcaagaccagcctagctaacatggcaaaaccctgtctctactaaaaaaatacaaaaattagccaggtgtggtggcacacgcctgtaatcccagctacttgggagcctgaggcaggagaatcacttgaatccgggaggtggaagttgctgtgagctgagattgcaccactgcactccagcctgggtgacaaagtgaggctccatctcaaaaaaaaaaaaaaagtccatttttggatttaaacgataaccagggctgactggatccagggcggggaataagaatactacttgaaagtcggttttatctccctgcttccctcacccccagactagaaaagagggatggggcataatcgggaatgaaggagaaaatgtttacctgcggttttgttcccgagaaaagaccctatttcttaccctgccttctccattaagcctgggagatggggaaacaatagaagccccatataggtcaggggtcctctgagagcagaaggagctggtgttcacagacaggtcaggagaggtgagaggctgtggggccacactgtagagcagagagacacaagcagggatgagcttggcagcgtgtgttcaagctggccaacaagactgcaggacccgtttcctgtgggctccccactgccccctgaccacacacaggaagaatacaacatttcctgggtgtctgagagcagcacggatgtagccaaaataatgtccaaccaaagattagtggggataatcgatgtctccgtgggtgctgggtgcgtaggtgacatccaggatcggaggccctaccccatggcatgatagagccactggggcttacatgccatcctggaaccaggggagtgactgaggcctgaggtgatgaaaggcaagtagcaagtttctgctgcacagccaaatggtgattcaaaacagaaatggattccagtgaagcaggcacctctgactttatggcctgagatccagacccttcacagcatatcagcaggaagggttcagcgaggctttggtggtatttggctcagatcctggtttgctgctctgcttcctcttcacgaaggagacatgcaggaaaggagtagtagcagcggagacacaaaaagctgctttattacaggctgcttctgtgctcaatacccttgatgtggcgagtgggcgggaacatgaggctcagtttctgagccccatgaggtcaagactccctcctcccaagcttgaaaatcagcatttgaccatcttttggtcaacataggggagaggaacctgaagccgtagcaagctcacttaggcctaaagagagagcgagccaactgggcctgcctggaaagactccagccctgtcataccctcacagctgggacacggagtcagaggaagctagggccatgcaagtgtgacaccagggaccctgctcaccctcaagcatggcagagacaatgtcctcaccagatcagtgctgcctctgcacgcaggggaagggggttgaggaagtagagacggcaggaaagcacaagcatttttatcacggttttccccactttgcattatatcataaacattttctcatgtaattaaaattatttcaaaacctaatttttaaaattttattttaaattttatttttttttgagatggagtctcgctatgtcatccaggctggagtgcagcgggtgcgatcttggctcactgcaacctctgcctcccaggttcaatctattctcctgtctcagcctcccgagtagttgggattacaggcatgtgccaccacacccggctaatttttgtatttttagtagagatggcatttcaccatgttgactaggcttgtttctaacccctgacctcaagtgattcacccgcctcagcctcccaaagtgctgggattacaggcatgagccattgcgcccagcaaaacctaattcttaaaagcttattatttcatcatgtgagttgagacttttaaaatgttcccataaattcaggaaaaaactgattcttccgtagccacagtaacatgtagccatcagaactggttttaaatccgttcaattaatcagtgacgactggctttggtgaacacactttcgtaatcaaccaagaggtgtcagcccctgacttcgaaaagccagctaatcagagatgaactcgctgcagcaaacatacctctgaggccaaccaatcggcaacagtctcacacaagtcgctggacttctacttcacaatgtcaagccgtggcttcgaaaggacctcccacctccatctctatgccaccccaaaccctgtacaagatctaccatctgctctattcaaagggactgtgcctgaccggcatagctgcccgcccccatcccctttttttttgagacggagtctcgctctgtcgcccaggctggagtgcagtggtgcaatctcggcttgctgcaagctccgcctcccgagttcacaccattctcctgcctcagcctcccgagtatctgggactacaggtgcctgccaccacgctcagctaattttttgtatttttagtagagatggatgttagcccggatggtctcgatctcctgacctcgtgatctgcccgccttggcctcccaaagttctgggattacaggcgtgagccaccgtgcccggccagctgcccctttttatagttagtatgtgatcacctttctctttttatttgagatactgacaggagatagcatgacttattgaaccattcttctattgctggatatttagattatttccaatacttaatcataaataaaactgtggtatttatctgcacataaaaatgtttcattgcaccactgattatatttttaagataaatcccagaaagtgaaatgactaagtcaatggatagaaatggttttagagatttttataaatattgtcacagtgctttccagagagactgtatcaatttacactcatatatatcattgtctggggtgcccattctgctatatgtttgtaagaattaagtatttcaattaatacaatctttgccaatgtaataagaatagtttcttattttaatttgtatttatttctgagaatgaatatgctagttgtttccataacacctattctcccttcttccataagaataaaatttttggttgggcatctgctgtccagaataaagactacattttccagcctcctttgcagctggacgtggtcatgtgaccgcatttaggtggcatgtaaatggaggcactgtgtggcagcttctggaaacttccttttgaggcgccatgtaggtgaacttggattcttctctgtccacttcccactcctcattctgatgcctaggctttaatgcaagcttggaccacaaagttgaggactgcaccacagggatggcatagggtaagccagactgtgacctgaatgtgagagaaataaactctcttgtttaagccactatttagatttggagttttctgtgactcactggtgattctaatcataatgaatacacccctggtttattggccatatttcctgaccttctgttctgatttgccacctgctgacttgccgcttccatctaagctgtccccctgagaacataacaatttcacatctcaacagttctaagtactttgagggtaggagctgtgctatagtcatttatcatcccactacccacaccctacacaccaaggccagtgatcaataagcaggtgcttatcgtagtactcaatatgtgtctagtggttgaagttctcctccccttcatgaatattcttaatctggagctatagctaggctttaagagtccatagaccactccctaaagttttattcaaaccttttattttagtttattatattttattcatatataaattttttacatatatcctatatttttttctggaagagaatctaaatatttcagcatatattttcaaaggactaaatgactcaaagaagtttgaatggcactgtacctatgacacactggaaccaccattctgccccaccaataggcttaaaaccattactttttcttcagttcattggtccatcacatttccactgccttacccaattcagttatttctcagtctcacgttgacagtattctcctgacctgtctccctacctcaatcattagcccatctctaatgtgccctggacctctatggtgactgtcctgccgaaggatcagtcctgcttaccaagtccacagtccccaccctggtactcaaggtccttcgtgataaggagcccatgtctctttcaaacaccacctttatcctgttggagatcaacttctcaaagacaggaatcttttgtctgttctgttcactgatatatcccaagaccaacacacaacacaaccaataactgctgaatgaatggaggaatgaatgaatgttttctaatatggattaatggggcttttccagatcacttttttgctttgcagtctctgtccctctgccataatcctaccaatataccatgactagttcatatgctaacattgttttctttgcttatttcccttagaagtgatttactttttgccctttagtatttagagtcctggtaacatgcatggctgttctatagtcttttgaaaatgtgtcttctttctgaataggttattaacacagctcgtggctttggcatcattgttcagcccttagtagttgcttgaaaaatactgtttaatgaattaattaaaaaaagaaggctgtatgggctgaattggtgagatttttatagcttttagataaaaagatggctatttctttatctccacttagcatattaaaggtaaggcagagggagaggtggaagtgaaaaagtttctaagtatagaaaaatatgatttactatactttttattttttgttatttcttctaagtggagataaaagagaatttggggtaaaatgaaaattggacataaatttacccaaaaaaaggcatctttcagggtgcagtgacttgcacttttaatcccagctacttgggaggttgaggcaggaggatcatttgagcccaggaggtggagcctatagtgagctatgattgcaccactatacttcaccctgggtgacagagcaagaccttatctctttaaaaaaaaaggcatttttttgtcttggtaaacaatttgttttatatgccataaatagtttaaggcatttaaaaataattcaaatatttaaagaaagttgatgataaaaaataaccttttaaagacataatttaatatcaattcaaagaaaaaactctcacattgcagttataacttccccaaacattgtactaaacaataaaatcttactaacttagttgaaaacacaaaagctaataattgttcctagcaagttactattaagtagtaggcagactgtcatttacaacacttctgattatcacatttctaatttgaaagccccttcttgaaaagagtaatcgagacaggagagtggtaggaagtgagcaaacatttgtgtactatctactaagtgtcaggtatgaataagattgttcttattcttgatgttgtatcctaagacttttgaatcttatcttaagtcaaggacaagttctcagtttgatgtcatcatcacaggaaagggtactttaattcaagaattcttgtcctttttcatcattacatataaatcccaactcaagaaaatggcaaactagtttaaatagcaaaacatctgcaaatgtcactgatccatatttagtgactcctcagtttcaattcgtttctagaaaattgactgaatcatgttagatggttgctttacccagaaacagaagctaataattaggaactacaagtgctcaggtttttgtcactgcctattcattttataagaatcccataggaaagccacatactttattaaagaaggaataaacaagaccgtttttgagaagtgttgtagtgtatgcttatcaatacccctatttactaatacttaacaaaagctctttttcctatactggacctactgagttttccattaaactcagtactgagtttctcattaaatactggacctactgagtttctcattaaatactgatgaatccattctaagaagaaatgcccatatattcctgaatttggtcctatttctgaatatgtctattggtactggatacattccctgtccacacagagttagtaactgtggtcagttttgtggacttttataatatttatttaatggcagttaacctaaggaatagcatgggacagttgattttcttctctcactataattcaggactaattttctcaccattgcaacatatatttacatggctaacacccataaatgatcacataagatttacatgcatttccccaccctgctcactgaataagaaagcaaactgtgaaacaagcttatggaaatagttaaagaattaagatctaatcatatttcaaagctcaccctcagagaagctctctgaagcaaaggccgcagaaactgaaactcatttattacttgggctgaaatacaaactttaagagaatgagggagaaaaaaacctttactttgctctagggaagaagcaactattctctgatgtgcagaaaataatttatcctcaaagaccaaatgtaaatggggtcaattaattttttttaaaatctctaccttctgtaatatttttctaagtctttgacactgttacactttatactaaaatctaatgtgtgatttgacaaatgtcaaaggaaactgactactgtatttaacaaattttaataagcataatgtatactttaaatatacttaacacaaaatttacatgagtggccattctgtggtatagtactcttaggaagcagatagaacacctatgtcaaattttgacttcaaagatttaaaaaatagtgacattgttcaatgatcaaatgacatgaatcagccaagtaataaattatttgaattataagctttgaatctaggcattagatgccccaatttggcatgctcataatgtcttattttttgtttttaaaattttttactttttggttcaattgggtaagaaaaaaagtaatgtatattaattggaaagtttataaaatatatttgcactaagctatgctatgtcagatttgtagacagttcaatataaaacagtggtctcaatacttaacaaaagctctatttcctatactggattattttgagtttagaatagctgctgaaaggacgttcttgagatttaagcattagctgtttctaatttaaaatgacctagactcaaggatacaaaatcaatgtacaaaaatcagtagcatttctatacaccaataacatccaagttgagagccaaatcaggaatgcaatctcatctacgatagctacatactcacaaaaataggaggggaaagatctctgcgaggagaattacaaacattgctaaaataaatcatagatgaaacaaacaaatggaaaaacattctatgatcatggattggaagaatcaatatcattaacatggccatactgccaaggcattttacaatctacagattcaatgctattcctatcaatctaccaatgtcatttttcacagaattggaaaaaaaactgttataaaattcatatggaacaaaaaaaaaagcccaaataaccaaaccaatcctaagcaaaaagaacaatgctggagggatcacattacctggcttcaaactatactataaggctgtagtaaccaaaacagcatggtactggtacaaaaacagacacatcgattcatggaatggaatagagaacacagaaataaagatgcacatctgcagccatctaatcttcaacaaagtcaaccaaaataagcaatggggaaagaactccgtattcaaaaaatggtgctgggatatagatagtgggctagccatatgcagaagaatgaaaatggatcccttttaccatatacaaaaattaactcaagatagattaaagacttaaatgtaagacctccatctataagaatcctagaagaaaactcaggaaacaccattctggaccttggccttgggaaataatttatgaataagtcttcaaaagcaattgcaacagaaacaaaaattgacaagtggaacctaattaaactaaagatcttctgcacagcaaaataactaccaacagagtaaacagacacactacagaataggagaaaatattagcaaactatgcatctgacaaaggtccatccagaatctataaggaatttaaacaactcaaacaaaaaacaacctcataaaaaatgggcaaaagacatgaccagacatttctcaaaagaagacatacaagtggccaacaaacatatgaaaaaaaatgccccatattactaatcagagaaatccacatcaaaaccacaatgagataccatctcacaccagtcagaatggctattactaaaaagtcaaaaaacatgttggtgaggctgcagagaaaagagaatgcttatacactgttggtgggaatggaaagtaattcagacactgtggaaagcagtttggagatttctcaaagaactaaaaatggaactaccatttgacccagcaatcccattactgggtatacaaccaaaagaaagtaattcattctaccaaaaagacacatgtacatgagtgctcactgcagcactattcacaatagcaaaaccatggaatcaacctaggtgcccatcaatggtgtattgcataaagaaaatgtggtacatatataccatggaatactatgcagccacaaaaagggcgaaatcatgtcctttgcagcaacatggatacagctggaggccattagcccaagcaaataccacatgttctcacttataagtgggagctaaacattgggtactcatggacataaagatggcaacaatagacactggggactactagaggtgggagggagaagagggtaggggtgggaaaactaactgttcagtactatgctcagtaactgggtgacaggatcatttgtaccatagacttcagcatcacgcaatatacccaggtaacaaacctgtacctgtacccactgaatctaaaataaaagttgaaaaaaaaataaaaataaaattgaaaaagaaatataagactatgcaaacttttaagacaacatacattatctgcactaaaagtttactacttttcaagaaaatatttaaaaaaaaagaataattcacatttaaaaaatgggtaaagaacttgaataggcatttctcaaaacaagatacacagaaggctaaaagcacctgaaagttatttaacatcattagtcattaaataaatgcaaatcaaacacattgaggtactgctacatacccagtagaatggcaatagtaataataataatgatgatgatgagaataacaagtgttgatgagaatgtgtcaaaatttgaactctcctagattgttgacaaaaatgtaaaatgtttcagctgttgtagaaaacagtttggaagtttttcaaaaagttaggcatagaattcttatgtgacccagcaattaccacccaggtaaatactccaaagaactgaaaacaggtactcaaacaaatacttgtacacaatttatcataacacttctattcacaatagctaaaaggtggaaacaattcaaatgtacatcaaccaataaatggataagaaaattgttgtataaaaataaataaaataaaatgacttagagtgtatctagttttccagaatcatctacatcaaggctgaattacttcgccacttcattttaatataatattcaaaatgtttgaaagcaataagtatgatgcccatacaaaacatgtcttatttccccgttcagttgacaaaaataaggtgtccagttggctctgttgctttatagttgaatttcccatcacccagaccctaaaatctacttccaccatctttttcattacataaagttcctttgatcgactatttcaactgttgccaggtggtaagcagtaaagcatgtggttaacagcatgggctatgaagttaaaccaacctgggtggtgtgaccatgggcaaatcatttaactttcctgggtattattttataacatgtagataaagtggacaataaagattaaataggactgaggtttagcaatgtaggagtgatgcaagtgcaagatggcaatggatcagagagtagtgagtcagcactggaatgaagacaaacactaggttctttatgcgtgagaaaatgggaaaaataaaatgcaaggcaagagcgatcaaaaggagaatttggtagactgaaatcctggaggtgaactaggcgagtaatgttaggtctaaggcatggctgcatttttgcatggtctaaagtggaaacaagatataacagaagtgactttactacagctgagcttataaacttgcagggtcagactgttagaaaagacacctaccaaaacagtcttttacagtagattctggttactctttcttattcatctttccactttaaacccaaaagaactatttgcctcagcttctttactggggaagcaattttcttcctggcatgtccccaagactggggtgctctgctactttttctttttgtttgagacggaacctcactctgtcgcccaggctggagtgcagtggtgtgatcttggctggctgcaacctctgcctcccgggttcacgccattctcctgccttagcctcctgagtagctgggactatgggcgcatgccaccatgcctggcaaatttttgtatttttagtagagacggggtttcaccatattgaccaggctggtcttgaactcctgacctcatgatccgcctgcctcggcctcctaaagtgctgggattgcagagtgagccaccatacccagccagattttctatttttaataacagctgtagtaagatataattcacatatcataaagttcataatttaaaactgcaccattcagtggtttttagtatattcatagatctgtacatttatcaccacgacaaaattctagaatattttcatcacctcaaaaaaacaaaaaacaacaaaaaaagaacccatccctattaacagtcacttcccattctcccatcctttgagccactggcaaccactaatctattttctgtctctagggatttttccactctgggcatttcacgtaatttaaatcatacaacatatgacctttcatgaccagattctttcacttagcatgtttccaatgttcatctatgttgtggaatgtatcagtacttcattccttttcctagtcaaatccattgtgtggatataccacattttgtttatccactcctcagtcaaacatttgagttttttccactttttgactactatgaataatgcttctgtaaacattcttgtacaagtttctttgggaaatattttttcagttctcctgtgtgtacttaggagttgaattgctgagtcatgtggtaactatgtttagctttttgaggaactgccaaactattttccaaaatgactgcaccattttacaatctcaccagcaaagtatgaaggttctaatttctccacatccttgccaaaactttcgtctgtcttgttgattacatccagtctaatgggtatgaagtggtatctcattgttgttctgatacatgatttgtgattatttccttctatctgtgggttgttcttttactttcttggaagtttcctttaaagcttttcattttgatgaagttcagtttatctattttttcctttgtcatttgtgcttttagtgtcatatctaagaattctttgcctaatcctgaaatgtcatgaaaatttacttgcatgttttcttctaagagtttcatagcatttttctctgatattgcttttttctaaaagttttatagttttaccatttatttttaggtctgtgattcactttgaggtccttttatgtgtatcttgtgaggtagaggttgagctttactcttttgcatatggatatctagttgtcccagcactatttgttgaatttccatataaatttcaggatcagtgtgtcaatttatactaaaaaaggcagttgggatttcggtaggattgtgctgaatctgtatatcaatttgggtaatactggcatcttaacaacgttaagttttctgatctgtaaatatgaatgccttttcatttatttagattttaattttttcattgatgttttgtagttttcaagatacatattttgcacttcttttgttaaattctattcctaagtatttaattatttcatgctattttaaatgaatttgttttcttaatttcattatcagattgtttactcctagggtattggaatacaattgatttttctatattgatcttatatcctgcaaccttggtaaactcttatttttcaaacaggttttttttttggtaggattcctgagaatttttctgtacacaagattttgtcattggaggatagaattttacttcttcctttccgatcgggatgacttttcttttcttgccagacttcctaatttctgtcagtctattagatataacatttcattagtgtcttatttttcatttccttggttactgacgatatgagcagttcttcatgtatttatgggctactgatatttacacctctgtaaaatgctgttttgtctttagccaattcttttttttttttttttttttgctgttgttgttgaggcagggtctcactctgtcacctgggctggaatgctgtggtgcaatcacagctcactgcagatttgatctcctgggctcaagctatcctgctgcctcagcctcctgagtggctaggaccacaggcatgcaccaccacacccgacgacctttttatttttactagagataaggtctcactatgttgcccaggctggtctcaaacttttaggctcaagtgatccgcctgccttcgtctccctaagtgctgggattataagcaaagctgctacacctggccttagccaattcttttactaaactcttcatttctgacacatgccaaatttctatggcgtgtgtcagaaatgaagagcttaacaaaagaatattatgccaagtttccataactacatctatatcatctatatatatcaatatatggctttatgtgctctctattctgtttctttggtcagtctatctatacttgtaccagtgccaaactactaacgtccatacctttgcaacaaattttgattttgtatgtggtaggagggaaatacttttgactttttctttttcagaataattttggctgctcttgggccttaggccaggcacagtggctcacacctgtaatctcagcactttgggaagccgaggtgggaggactgcgtgaagccaggagttcaaggtcagcctggacaacaaagcaagacccccatctctacaaaaaattttaaaaattcagctgggcatggtggtgtgcaactgtagtcccagctacttgggaggctaaggtgggaagatcacttaagcccaggagttcaaggctgcagtgagctataatcgcaccagtgcactccaatgtgggtgacagtgagatcctgtctttaaaaattagatttatttttgtcagataaatccaaggaattgcattaaatctataggtcaaattgaggacaattgacatctttaagatacttaaggtattcaagatttagtgggtatatttctccatgatttaggtcttctttaatttcttttaaaacagttaaaagttctccaaataggacttatacggctattcttagattcattcctatacactttctattttgctgtgttagcagaatcattttttaaattatgttttctgtttcttgctggattatatatttagacaactgctaaactgtcttattatttccaatagtttactgatccacttaggttttatgtatagattttatgtacagacaatcatatcatcagtgaataatatcaggttgcttccctctttctaatttgtatcctatttctttttcttgtatagctgtgaccaatggcatctgtatttcactgttgaacagcagcagtgattaacgggcacccttctcctttcctgattttaaagggaatccttctaacatttcaccctaaaaatgatgtttgctctaagtttttgattaatattctttatcagggtaaggatactccctcctattcctagcttattaagattatcacagatatgagttgaattttgccaaatgcttttctttacctgagatgatcacatggtttttctcctttcagtgtggcaacgtgatggattatattaatggatttctaacatgaaatcacccttgcattcttgcattcagtccagcttggttgaaatgtataaacatttttatgtactgctagattctgtttctaaattttggttaggaattttacacttaaaattaaatgtaagattggtatgtaatttgctttttactgttcctggctgactttcatatcaagactacactggctttagaataaatgggggatattacttctttttttcctgtcacagattttgtttattattggagttttctgttccttgaatgtttggtaagaacttgaccaaaatcatttgagtctgatgttttctttaataaaatatttaaaactaaatgctatatttatttaatttctacaggactattagagttttctattctttcatttaatcacgttttctaaaaatgtttccatcttatccagattttcaattttattggcataaagttattcattaaattatcttttctatgttttttgactcaatcagcagtcatttttcctatttcctcctttccctatttgtgtcttctccctatttttctgaccggtcttctaaaaagtttatattttactagtcttttcaaaggatcaaactttgcgtttgccgaattactgatttttaattaaaacctctaactcctatggcatctatgtccttatttcctcctggttctccagggacctctctgacaattgcttatcgatctatagctggttttaaataattgccccattccatctgccctttccttaccatagcaacctctccctttttaatccattccgatagtaaatcatctttttgttgatatgacttccaaattcatccctagccactacagccttggtacccagatccagacacctctctgtgatgtcccaaaggcactcaactaactgaactcgatcatttcttcttgagtctgttccttctcatcttagttagtggcacttacatttagacacccaaataagaaacttagtagaattttttagaatccctctctctcgctcttgacagtcctgccaacttttacttctagattttcacctttctctcctgaatttttctagtagccttctaacttattgtcctattcactctagatatttcatttttgctgtctgatatagatccacccaccatctttcaactgatactctatctaaagtataaatatgatcatatcactttgtaattaaagaagcaattttcattgcttcttagcaaatactaaagttcaagttccttaatggggcatacagtaccattcagggccaggactttacctctccagcttcatgtttctctacttcccactctaccttttatgcctctgtgaacaccagactttagttccctgaatatgctatttcacaccctgtgtttttgtcccattttttttttcatgaatatcattcatttccttggtaggatcttaatcatcttgcaataatcatttgaacatcaggaagtcttccacaaaacctcaagaaatctcagtttgggccaagtcacatttctctatcggcctatacacaattattttattgcttattatattaaaattatctatacaactagactgacaactctttaaggggagggggaatatgttgtacatgttaactccaagcatctagcatataataggatgcaaatttagcttccttgagagaactggatcatagcccacccttctactccaagtctatatcctaactgttgcctgacaggctcagtgtgcctcacaggaagggagtagcagctgaaactgaccaaaggaacagaggaaaacaaaatgggtagccttgcctcttccctgcctgtagaagaagctggcagcttaaatcctgggcaagagtagattagacagtttgctactgaaagtgcttaatttgagaatgcagtatgggacttggaaggcagagcttctagacaggggtagttcttgacatttgtgtcctaaaggaaagagagccatttttggctttataagaagaatcagaagcaaagactataagggatcaaggtttccaataaaccaagctagggatcagggcctgattcaaatcccagcacggatctatgatgggaactgagaccaaggacccaggtagaagcctggggaataaggaaaaaggtgagcagtaactagggaagatgcagatcatgactacaagggctcctcaggggtcagttcagtcgaggcccagcaggtgctgaatgtgcaagctgcatttctatactcttgaagcagcagtcctcaaaaaccaccagcttgggcccagctggcttcagtgactgggcccagtctaagtgctctaaatcattctctcttcagtcttaacctctccagtcctcagctccttcgatcctcgcatggaaatagccttaattaggacctatattttctaaacacagggctcaggccattttctgaaagctctgcttgcttttggcttttcacagtgatgctctaacatagtggctcccacccaggggccttagatttaggaggcatctcaacattatcagaggacctgaggaaaagcctgttagaagagcttggggcttgtaaatagaatctctgtgatcttctgctaagttcttcaaactgttcagtctcttctaactaggccttggcagaatcactgctaaaccttccatcttagtctaacacccttgcgttggggatgtacctgacatacaggcaccaactggcattttatttcctttcagaccaaaatcagcactgcaggctaccctatctatatcccaattacactttattttgatcccatttggaatgggggggaggcttaatcttcatatgattttgggggggatttgattaagtctaatgtcagactgatttattacagcattagtgtaaatcttttagatttcacgagaggaaaaatatcaataaaaggatgacagtaggggatgaaaaataaaacaagaaaccaaaaccttgagaaataattttgtaaagcttaaatgtctgttaatgggctatagcatttaaaaatatttctccaaacaggattagaatgaagaaagaaagtaggaaagatgatgccagagtaacaggagaaaaacgcttttgagctttttctactgaatcagccaccaggatcttgtggcccaggaatctgatttaaaagctccctggttgcttctgataatcagctttaggtgaagaaccactgttctagctaatgaggacaaaacagagggcacttccctaagtaaaagtataaggacagtaattgatacaaaacacatgatttctgctaaccacttctgccatattatctagtttctatgaaaactttttctctgaaaagaacccaaccagttgagattatctattctaaataaatgaatatcatcaactttgataacccctaaagagtttctatagtaacacagaacaaagataataaccatcaagatctaggtaatcaagactgcttagtgtgcttaaactggcttactttaatggttttaaatgcagtaaaaaccaaagagctcagctctaaggaatcagacagcatcgctacaagaatatttaattatgtggttccccctaaaaaaacccaaataaaatacaatgaaatatattgtttaatcacaaaagcaattaaaatacataaagacaattttcactgagtccgcaactctcagcatgtaattatttatctaattcaagtcatgcagctaggtgttggaattaacttctctgaactagatacaaaaatggaaagtcattttgggatttgatcctcattcattttcaaccaaatatccaaattcatttccaattcacacaagaactgccgcagctttacctaaatcagttttctacaagttaaacagcgctcctacactcagatgtgattgtggaactactttgatctttattcccaaacttattgctccatgtaatccatgacaaaatataatgtgatttactatatctctatatgacagcacagcagctgacagaacttaataatttagcataagaaaaaaaccttctggcaccaaaatacacagatcgtaatggggactctttagtatcagtttacaatgaagcctatacaagctgatcctaagaacttcaaaacaattcttttttttcatcatgcatttaatgaaggagatttttattccttaaacatgctttgtagctgcaagcaagtaattcgggaacattttgtttttgttctcattaaaacaatgcagaacaagttacataccgatgtctctttctcaaagaaaagtactaaatttctccattttcaagtaagtgaagaaatacatcatacaggaagctaaaaactctttaaaaaaaaaagtaaatttacgttgtgttatgttacataaaaagcagagattagataattaggtactgtatagagaaccatcagaattaggtgaaatcaagacctgtctctgaagctgctagagctgaattttctctgacctgcacatgtacccctgaacttagatgtttgaaaaaaggaatagaagctatataccaaaagagggtactgttaagtcagaacatatggctggcactgatatgttttagtagtgggtatttaaaaaaaatatttcatggaggaaattgcctataccaaagattatataacttccttagtaatctagaaggtactgttaattcatttttagtaatcaagaaaatacacgattgaacacctctttttagctggacgcctagtgggcactgaggatgtagccatgtccaaatcgaagctcctgtctacagaaagcttaccctgcactggtggggggcgagggagggggcacacacaataaacatatagaccaataacggagtaacagagggatgcatgaaatatgaaataataacccagagtaagagagtggagggtgaagatagctcatttctttttagcactgaataatattccattgtttgggtagtacagtttatttacccattcatttattcagaaaaccaaataccgcatgttctcacttataagtgggagctgaatgatgagaacacatggacccatgagggagaacaacacacaatggggcctgttggaaggtggggagtgggagaagggagagcatcaggaagaacagctaatggatgctgggcttaatacccaggtgatgggatgatctgtgcagcaaactaccatggcacatgtttacctatgtaacaaacctacacatcctgcgcatgtacccctgaacttaaaagttggaaaaaataaacaaaaaataaaaactaaaaatgtcttcctctaattcctacaagaactcacactttatctcacatattctctctctctctgcccttgaggcaacaggtggcaaacttacctaaatctgctttgctaatactttgaacatagacacattttcctttatttctcagccttacttagtccatcatttatgaaaactggatctaaaattgagataaatctgtaccctctaggtttgttaatatattcttctgctccaataattgttctacagaaaaatagcatttgtgtattcctggaaaagttcttctggaaaggataatctttgttgtacaataatcctaacttcattacctttctcttattccttcagtttgacctatatcttatttctctgtgagtgcccccattctactctccatagctacgaagcagtgattatggaaaagaactattcctgatgaaacaaaaagaatgatagttttcttgaataattcagatattctctttccactgaaacttctgtctattcaacatttatggaatgcctgctatattctaggtagtcttccaggcactggggatacagcagtgaacaaaacgggcaaaatttctgttgtcatagaagttacactccgatggggagtaataaaaagctgtattggcatgtatagtcttctgttgtagggtaaactcacttaaggccatattcttaataatcattttcatctttgtacgcatccccatgacaaaatatttcgcaaaccatagaaaaaggataaatattcattaaaagaatagacaaatgatctgtttcatagcttcaatctttctccttccactggctcatttcctttgccaaatctgaagacagaataagctacttctcaagctgctttctccttctttcctttccttccctctataatgcatttaaaggttagtctgtgcctacaatttctactctctaatttctccacatcccaccactttactgaaattggtttactgagggtcaccaattacctacaggaaactccccctggcgaaactctcaacttctctaatttcagaaaaatatttcccattgcctactagaaagctccaaatgggtatcctgatggcattaaacatgtgaactccatcattttctccttcgaatgtacctttcctctatgctccctctgtaggttgatggacggcatgacaaccttggacaccctcctcaagtctccctttcctttccacccacacccagtcaggaatcgcacctgcggcttctaccgtctccccttccaccaccactgccttagtccaaaacctgtgtcacttcccaagacaactgcaatagtctttcaaccagtgttccctttcaacaataacagtggtcacttagaatgtgagatccacaagggtggggactgtgatctgttttgttcattgatatattccaagtacatggaacagtatctgacacaaggcaggtattcaacaaacgtgttgaaagaacgaataaactaagtgctaggcatataaagccctttaatatatactctctcatttgatcaacacaaaacctatgaggctgggattgtcatccttattttatagatggcaacactgtcacttggtaagctgtcctagtcacagagctcataatagtgggaggtaggatttgaagccaggtcagccagtctcactctgaaacaccagctcatgatcacactactaactgtctaaaccactgagattcttaaaaattggttattatgattaaaggggtagctactatttaatgaattcttactaggtgccaaggctttgcataattacttcaccaattacaattctacaggagaggtattaccccattttacaattatgtaacctgaggctcagtgagtttaagcaacttgtcaaagaacagtaagctataaagcaggaattcagactccaaaattctagactacccctggtttcttacaagtactatactagaattatttctctaaaactcaccattttggctgggcacagtggctcatgcctgtaattccagcagttcaggaggctgaggcaggaggatcacttgaggtcaggagttcaagaccagcctggccaacatggcaaaacctcttccctaccaaaagtacaaaaattagctgggcatggtggtgcgcacctgtaatcccagctactcaggaggctgaggcataagaatcgcttgaacccaggaggcagaggttgcagtgagctgagatcacgccactgcactccagcctaggcgacagagtgaggctctgtctcgaaataaataaataaataaataataaaaaataaaacttaccattttattccactaaaaaatcttcaatggtgcctaatccacaaaaaataaggcccaaccccctgagtaaggcatttaacactgttcacacttcggtaattagctctcatttacccatttcaggtagagtttgccctggccacacggggtctgccctttgaatgttttctgggcctctatattcttcctcgagtgctcccaacagttagaaagcctttgccacttgttccagcccatcctagaagaaccagttaaagttacatctctcccaagctttctcagattccaccactgagaatgatgaattctgctttccccttgattacatgagccctgtgtacctctaatgatggcttctgtaacagtttgtctgtagcagttatgtagatatgtttgtcttcctttattagactacgattcctcagaacacaggaaccttctctgaaacccttataagattagcacagttctttgtgcaaaatcaaccactgcagcctgccgaatgaactgagagaatggcctggggctcatctgttgcaggtaggataatacatcaactctgtatatgagggtatttttcttttgtactcattgatcattactttaaaaattagcaaacaatacttaagcaatataaacatttaaatttcttctacgtagaaatcagatactaaactctattttttaaaaaacctcactgaagcgggaagatcccttgagctgaggaattcaaggctgcagtgagctctgattgaccctgactctaaaagcaaaacaaaaacaaaaatgcctcaaacacctcatacagtttgaaaatatcagttaaagtcgaatattgtaaaaatgtatgtgtctttaatattggtgccttggtcattcattatattaataatatcttgggttgggcatggtggctcacgcctgtaatcccagcactttgggaagctgaggtgggtggactgattgagtccaggagttcaagagcagccttggcaatatggtaaaaccccatctctacaaaaaaaaaaaaaaaaaaaaagacaagaaaaaaaattagctgggcttggtggtgcacacctgtagttccagctgcttgggagcctgaggtaggaggaacacctgagcctggggaagtcgaggatggagtaagctgtgattgtgccactgcacaccagcctgagtgatggagtaagactctgtctcaaaaacaacaacaacaacaacaacaacaacaacaaaacccatctttgatagccatcatggtatgtaccatgatattcatttggatattaagactgatgatcagtaccacagatttcatattcttctgttcccattccttggcttccacaagagtgactggttctgctggagcagcataacatctggagtcatacactcaccacccaagcccggacacaacttgttgatattcatctgcaaagggattgttgagatgtccactgattacaatggtagcttctggacatagatgcatcttctagtacccagtaccagcatctaaccctggctcatttgttactgcctgtttgctagcttattcttgagtacttaaacagtttgtttaccatttgggaggataaagatacctgctgatctcttaggctgtcatacctacctcactagcatgtttgtttatcctatctgcaaattcagcttatgattttccttcatcaaaatgtcttgcttttcctgtatgaccttgactccaatgtcatgctgacagacatgagtcatgtttccagtttcaaaatatcacttgattataaaaatgtccagtagcttcataccacacacctgaatagtttagaaaggaagacacggcagttcaaggaaggctcattgactttcttcattgaatctggttaagtttgaagaggattaagtcattttttaagcccagttgaaagctggttcagtgcttatgctagtcacctcttctatccacttgtgaaaatcttcttttgcctgacaatcatatttaatcttgttcttgaccctgataaatcagtggagggacccttcatgtagagtatcattgtggttctagtagtgggggaggctgcacacgcatgcgagggtctctgatgctactggctaaagtggaaactggtgggagatgctggcatcttacttgcatagcgccccctggagatgactgggtggtatatgagtgtgggcctcagtcatatggtctagctgagtttgcagagcttcaaggtcccttctggaatcccactggttttccatcactatggttctcaagaaaatgcccccagccctctacactccttagagctttaggaattgtcagcctatgaccctgatcaatggagagttacctcctgatctcctctccaggtatttagtcataaaaaaaacacattatatatttataacttcaaaaatttgaaacctattatcttctcatatgtatctgagtgaaatattctttatctgaattagtgtatactggggaaaggctagctggctggctggcttctaagaatactcaagcaccttttctgaagtcatcagtaagatccaccatgcatcataatctggttccccatttttgtacaaaaattcaatgttgtgagtacccctgtgtggttattttaaaagactgactcacggactaaagttatagtagacctaggttctagggatatctccctactctcctatgttctactcattattcaatttcatttagatttgcacatcaccttgcttgcattctaaaccagcctgatgacatgcttaatacctgttatttgtcacaagcactgatctccagtactataatcgcagaacagaatttggaaaaatccgagaatttttactgtctcttgtttagaaaggttatagttaattgctttagaatccaaagctactgacatccttgaagtgcttttctgatgaactatgtgaccatggttttcaatccactaaaaaattaagagcaaataaaattctacatgaaaatgcattaggaaccagaatttgttccggagtgctttagtgaatcttaatttttattaatgaccgaaagccttcagaatattaaaatacacaaaaaatgaactaactcatttactagccaaagaggcagaaaccaaatgtttgaatttccttgactggtcaaaggtataatacacatattttaccctaaattagactcaaaagttgttcccttccacttggtttaaaaggtttaagtatatgataatgtagtatttaattctctagtgttacttcccttttattttgaggtgaaattaagagaaaatattttctaggcaaaaaatttcctgaataaggtgtattttctttcccctccaattctgaaacaaatctgtggctaacaagaatatctaccaatagaaacactttcctcttgacagcttaaagaagcttccaatgctgggatacggagctgggaatgtaagctggcaccggatcctctaccttacccacatacatctcattgttggttatatctcatgtctgtctcccactcaattctggggcttcagggtcaacaattcagggttttagtcaaatcaaggggtcacaggccaagaaactggatttcattttggatgcagtgggatggggaagaggtctgtgagcagggaataaaatgaatagaagtccagttgggaagatgaatcctctggcactgtggagaatgatccagaagagcagaggagacaactgtggcaatagtcaaagagcactgctgcccttaggcaagtcctaaagcaactacagttctgaggaggcaaaggcagtgaaaaggggctatctcagccttgtgcctctttctgaaacagaaagccacattgacgcaagtcaaacaactgaacaaaaggaaataactaaacaaaaggtaataatcctttatgcaccatctacctttctacccttctaccattgctcacacacacactggcacccacacactgtcacattcacaaatggatttttctatagttgttttatgtttaaaattttttaagtttgggtatatttctcagagtacatctagaaaaaatgcaagatgatgtattaagagatttatataaactacaggtgagtcatacataattcctcggaaactaagaataagaaacttgtcctctgaacatgaaatcagtttctcacatgttcttctgcttcttgatagactctttttcaatattactaactgccttttcttccatagccatctctttaaaaaactgagatataactcatttaccacaaaacacaccttttaagagtatacattttaatggtttttactgtattcttaaagttgtacaaccatcaccacaatctgattctgattttttttttcactacccaaaaaggaaatcaatagccatcattccccatttccctcgactgaaactctaatccacattctgtttctacggatttgtctattctgaacatttcatataaatgtaataatacaatatgtgtgcttttgtgtccagattttttttatttacatagtattttcaaggtttatctgtgtcatagtatgtatcaggaactcattactttttacagctgagtaatctttcattttatggatataccacattttgtttacctatccatcagtgactgggaatttgggttgcttatactttttggctatttatgaatcatgctgctttgaacatctgtgcacaagttttaatgcaaacctacattttcaattatcttggtatatcccctaggagaggaaatgctggattttataattctaagtttaattttttgagaaaccatcaaactgttttctaaagtggttgggctgttttaaattcccattgtaaaatacgaagattccaatgtgtattcatgtcttttccaacacttcctattgtttgtcttttttaatacagccatcctagggggtgtgaactagtgtttcactgtggttttggttagcatttccataatgactaatggtgttgagcatcagtggtgttgatctgcttactggtcatttgtatacattctttggagaaatgtctattcaactccattgcccatttgtcagttgtattatgtctttttgttgttgacttgcaaaattctttatatagtctattaggtttttatcagctggatgattttctcccattctgtgggttgtcttcattttctttctttctgtcttcttcatcttcttttttttgtcactctgtcacccaggctgtagtgcgctggtgcactcactgcaacctctgcctcctgggcttaagctatcctccaacttcagcttcctgagtggctgggactacaggcacatgccactacatctggataatatttctaatttttgtagagacggggtttcaccatgtttcctaggctggtctgaactcctggacttaagcaatcctcctgccttagcctcccaaactgttgggattacaggcatgagccactgcacccagccatcttcattttcttgatgttgctgtattctttgaagtacaaaagtttttaattttgatgaagtccaatttacctcttttctcttttatcacttctgcttttgttgtgatatttaagaaattattgtcttatccaaggtcataaacattttctggtatgttttacacttttataagttttataattttagttcttacatttaggtctcacaagttgctattgacaaattatctcggtttgtgtttatctgagaatattcttcattttaaaaggacattactggaagtagaattcttggttaacagtgtttttctttaagggcttttagtatttcattccactgctttctgaccttcatggtttccaaagagaaattagctgttaatctttatttctttagacataatattttagttctttgaacatatttcaagtaacttatttaaagtctttgtctattaaatccaacatctgtgcttcctcaggaacagtttctattatttttccccctgcccacgggaaataaagtgtgcccatgccacactttgtttctttgcatgtctcataattattttgcagaaaactggacattttcaatattttagtatggcaactctggaaatcagattctcttccttcccccagggtttgttgttgttgatggggacttttgttgtaatagtggtggtgatactgtttatttagtgacttttctgaacaaatgctgtaaagtctgtgttctttgtcatgtgtggcagctgaagtttctgcttggctagttagtggtcagctaatgattgggtagaggtttctttaaatgcctgcaaacaataagtcttccagttttctcattgcttttatggaaaagagactttgtggaggcttttactctgtcattttccctgacatcctctcagtacacttgttcactgttgtttgctacagggttacattctttccccttttctcttattccacaaaatttctctgggcaatatcatacacatctaggtcttaaaattctaccccaaatttattgacttgcaaaactacatcctcagcataaacattttccctggaagatgtatttgtaaatgatcaatagtcatttctatgtgtatgttttacagatgtctctagctcaacaggtcttaaaccactcacccactcagtcacacaaactagaaaactgggaggcacgctagactactcctttatcttcaattcttcactaaaacacctcctatcaaatcttacaacattccaccaagctcatcattatcttatcacattatacataccccatggaaagcatttatttacatggatgttcttactagactataggcatcttgtgagcaggaattgtatatatttatcatcttattctaggactcatcgtgatgcctaactcattatactcagccaaatgctttatctgtgtagcaggattgtattttccaaagatggccgcatcaatatattcctcttcccacacgctcttttccctatatagtgtcgatgctccatcaaggggtggagtcaaggagctctcatctcttgaatgtgggaagacctttacaagtgccttcaccaaatgaatgtgacagaaatgacaccacttgaaatctaaggctaagtctaaaaggtgatatgaattccacctggctttctgtcccaggacatgagccatggagtactgagctaacatgtgagatatccaggtaccctgaagctgtcatgtagacagactacatagagatagagatgccagaggagctccagctatatgtatcttctctctccaagtaccaggagcgtaagtgaagaagacttcaatatgacctcagttccagttactgtctgactgaaaccacatgagacactcaaggccagaaccattcagttaacgagcctccaaattccagaaacagtaagagataatattgctgtttgaagccactacacattttgtggtgattttgttatacaacattagataactaaaacaataaatgaagaaatgaagattagagtggagatatatcaatatcccctttcatttctctaccatgcatcattttaaagtggaaaatagttttaaatatgtgcttaaaacaaaagtatctcaaatttatatcaaaaagtttcaagatgtaattaatgtggatataaaatgaacatacatctagcaaggaagtcctttctccaaataccttaggtgttacattattttctcaaaatataaatgactgcactatgtaatcaagtatcacatgccatcttaaaaggtaaaacccctgttctttactccctcccaatagataatttcatgaagataatttctggatcatccacgttagaagtttctagtactataatatctaagtgcatcatgttcatgcattgactgctcttaggcaaacttttgctaaattaaatgtcttactgtgtttttgtagtttcctagtcaaaagagcatttttatgaatcatgagcatttctgttgattcttattttttacacagcaaaatttaataaacttaaaaatagtttataatgatggactattcaatatatcctagatgtagacaaatccactgtgtgtgtgtagcacaagtttaacctcaagctaatagctgttaatatcttaggattacatttctttagaacagatccttatttaacatagataaaagaaacaacattaaatgaaacctcatccagaagaattttctaactttcaataacctctcagcatgttttaaaaaacgagttgggattaattacttttaatttttaaaaatgtgtttcgtctggtttccctaagccaaaagacatgttaatttaaataaacacaagagaagctttgtattttgattcacaaatataaaagaaaatttttctgaattattaaaattagatgagccgctcataacactgttttgtattctatgtctataaagctcttttcaaaagaacaaatttcagtcatttatccatttcaaatgtagatgaatacatctaattactcactcaacacgtatgtttgaagccccatatcgacacaaaatttctcctagaagagatattaggagaaatttccttaattgacatttcattttgcttaatacattaatcataatttccattaagtgtgtttctgatgacatcatttaaaaagtatcttctctgagttttaatttctaattccagtctgctgcattctgggcagaataagaaactgaatgaaaaaattactactgctttgtgaattatttaaaatgcattatatagagggtaaatataaaatttattttcaaaactagacaaattttgagaataaaagtaatgttaagaattatactgaaaaataagcattgaaactggaacctgtggtcattctaaatatgaatcatatcctcagtatgatattaacaatattaaatatcaccatgttaggtgagggccacagtccatctagcaaaggacaaactctgtacaattaattttttttttttttgagacggggtctcactgtgtcacccaggctggaatgcagtggtgtctcaacctccacctcctgggttcaagcaatcctcccacctcagcctccagagtagattgcagtacaggtgcacactaccacatgtggctaatttttgtatttttagtagagatgggattttgccatgttgaccaggctggtctcagactcctgagctcaagtgacctggccactttggctcccaaagtgctgaaattacaggcaggagccaccatacctggcctacaagtaatctttatagtggcaggaagagtcataagtgtcctcattaacatcatcattttcatgtgttttatgatattttactatttctatgactaccgtaatacctcacttgcccagagatcagagttccagtggcaatggtgtgtattatttaggagctgcccttagtcccttgctcatgctacttgttgtataaactcagtcaacaaattaaaagcagctgccaaaagcataaagtaacaactgaaagaaaagggaggagacggaagaactataaaaaggagagaaaactgggataacaatgtggggtagattttattgtagggaatcttttatgtggtatcaaaacattctcaatgatgactctgagttgatgtctttagcatttttcgtttaaaagagtagaggagtaagtagagcgtgctagaaaaatatccttcaaaatggtaagctttggcacatatattgagattacattttagttttttggaaactgacttgcggaacattttattcctggacaatatctgataaatgaggtattcctgtacttccttttatttggcttgaaacaatctctttaaaactcttttaagcagtgctttgttgaaaaaataatctgaattaatccatccatggttttagcaaattttgccatagaatctctcaatgttctgcctaaaatcaaaactttaaaaaaatcttcatatggaaacaccttcattctctttatcactttagttttcctgtttcaaatgtttaccagttctgtattattttcagaattttaagctgcattatggatccattcaaataatatttgacacaaaagcagaaaaaaatattttattattttgtcctattctgtttccagagggttataagtatctgtgtcaatactactgtttggtgaaatcaagacccaagaattattcttgacagaatctttccagtctcaattagggtgctatagttggaaaacattagagattcatccatctatctattcaacacacttgtactggtgcctaaaacatgccaggcatgtgcccaggggaaacaagcatgcataaacaagtaaaacaataacaaaaacagtaataataaatcataaggattgagaagtagtgtagagaaaaaaggtagtgtacaataatagaaagtgatgggggatattctaacatttgggtggagagtaggtagtcattggaaaatacaagatccactatggtttgaacgtgtcccacgatattcatgtgttggaaagttaatcctcaatgcaactgtgttaagaagtgggaaccgtaagaggtgattagatcatgagggctctaatatcattaatatggtttggctctgtgtccccacccaaatctcatcacaaattgtaatccccacatactgggggagggccctggtgggaggtgactgaatcatgggggtggaattccccttgctgttcttgtgatagtgagtgagttttcatgagatctgatggtttaaaaatgtgtggcacttcccccttctctctctcctgttccaccatggatgggaagatgtgtcttgcttccccttcaccttctgccatgattgtaagtttcctggggcctcccagtcatgcttcctgttaagcctgcaaaactgtgagtcaattaaacctcttttcttcataaattacccagtctcagttctttgtagcagtgtgaaaatggactaatacagaaaattgatactaggatttgggcactgctataaagatacctgaagatgtggaagtgactttggaactggataacgaacagaggttggaacagtttggagggctcaaaagaagacagaaagatgtgggaacgtttggaacctcatagagatttgttaaatggtttgaccaaaatggtgacagtgatgtgaacaatgaggtccaggctgaagtggtctcagatggagataaagaacttattgggaagtggagtaaaagtcattcttgctatgctttagcaaagagacaggctgcattttgcccctgccctcgagatctctaaaactttaactcaagggaaatgatttagggtatcaggtggaagaaatttctaagcagcaaagcattcaggatgtgattggctgcttctaaaagtgtatgctcatatgcatgaacaaagagatgttctgaaattgtaacttatatttaaatgggaagcaaagcatacaagtttggaaaatttgcagcctgaccatgtggtagaaaagaaaaacccatttttgggggagagatttaagtaggttatagaaatttgcacagaggagccaaatgttaatagccaagacaatggggaaatgtctccagggcatgttaaagacctttgtggcagcccctcccaccataggcctggaggactaggagggaaaaatggttttatgggcccctctgctctgtgcagcctggggacatggcaccctgtatcccagcctctctggctccagttgtagctaaaaggggccaacatacagctcaggccattgcttcagagggtacaagtcccaagccttggtggcttccacatggtgttgggcctgtgtgtgcacagaaggcaaaagtttgggagcctccacctagatttctgaggatgtatggaaatgcctgaatgtccaggcagaagtctgttgcaggggcaaagccctcatggagaacctctagtaaagcagtgcagaggggaaatgtggggttggagcccccatacagagtccccactggggcactgcctagtggagctgtgaaaagagggccaccatcctccagaccccggaatgctagttccactgacaactttcaccttgcatctgaaaaagctgcagccactcaatgccagtccatgaaagcagctgctgaggcagtaccctgcagagccacagtggcagagctgcccaaggctgtgagagcccaccccttgcatcagcatgccatatatatgagacatggattcaaaggagattattttggagctttaagatttaatgactgccctgttgggttttggacttgcgtgggtcctctagcccttttctttttgccaatttctcccttttggaatggcagcatttacccaatgcttgtactcccattgtatcttggaagtaactaacttgtttctgattttacaggctcataggtggaagggacttgtcttagctcagatgagactttggaattgcacttttgaggtaatgctggaatgagttaagactttgggggactgttgggagggcatgattggttttgaaatgtgagaaggacatgagatttgggaggggtcagggatagaatgatatggtttggctctgtgtccccaaccaaatttcatcttgaattgtaatcctcacgtgtcaggggaggggcctggtaggaggtgattgaatcatgggggtggacttcccccttgctgttcttgtgatagtgagttctcatgagatctaatggtttaaaaatgtatagcacttcccccttctctctctctctcatgttccatcatgggaagatgtgccttgtttctgcttagtcttccaccatgattgtaagtttcctgaggccacccagtcatgcttcctgttaagcctgcagaactgtggcctcccagtcacgcttcctgttaagcctgcagaactgtgagtcaattaaacttcttttcttcataaattacccagtctcaggtagttctttatagcagtataaaaatgaaccaatacaatcatgaatagattaatgtcatcattgcagaagtgggtgtgatacaaaattgagtttggccctcctctttttctctctcaccatgtgccttctgccatgttatgacacagcaagaatgcccttaccagatgtagcaccttgatcttggacttcccatcctccagaaccatgagcccaaggaatttctattctttataaattactcagtggtgttctgttatagtagcacataatggactaagataagatctgaggggggaaatccagacaaagagaaaaaataacttcaaaggccttaggtaggaacaagcttgaaatacttacaaaaggcaggaaaaccacatgctggatccatgtaactgagggggagaggagtaggggataagctgaagagatgggcaggggccagatttccattttgtttcaatactgatgagaagccattggagggtttttagcatggaattatataatctcatttattttccaacagatttgattgttgtacaaatgaactgttggaggaagtaggtatgaaaataggaagaccaggtgggagttactgcaacagtccagtgaagagtcaatttagatttattttagacttgggtggtaatgacagacgtgatgggaagtggtttgatgtaagatatatttgaagcagcaggaatttttggtaggaagaatgtaggcgtgaaagaaagaaatgtgtcaagtatgactcagtactagttatgatatgaagaatattggggaagaattaagagctctgtttcagaaatattaagtgccagacatctattagaatttcaaggaaggtgtttaggaaaaggttgaataccagcctggaacttcagaaagagactaggactagagatacaaactggaagtcatcagcatatagatggcatttaaagcaatgagactgcacaagatgagttagggactgagtaaaggaagtgggggggggaagataaggtggtgttactaaaggagatggagtaggagcagctagccaattaggagaaattcctggagaccacgatgttcttcctaactgataatgtgattaaaacctatcagagaaggagtgatcaatggtgtcaaaacttctgagaagtcaactgtgatgaagactaaagacagagcactgcatttagtgcagagatcacttgttgattggacaaatgtttcaacatattgaagtggcgaagagcctcattgccatgaataaaagaagagaatataaggcagtagaataattaagtattaatagaaagaccttttgaagactctggttacaaagataaacaaagacgtggcacagtgattgaagtgagatttggattgcaacagagcatttactggtagttgaatatatacccccctccctattgcatctccccttccccacacacatttcctagccccctgcaggtaggtggagccttttgtctagttctggctaatgggctgtgattggaatatgggtcatttctgggccaaagtacaaagaattgggtgtgagctcttcatatcctgtctcctctagccatcggtgaccagtagtgttcaagataatggaatctttctatcaaccaacattgaacttacaatctgaaaaagtattaatcacattaaattattgataactaaccagtttagatctataaaaacagcactttcttatggtttcacttaacaaatctttgctgagtgaagccactgagatgtgggggtcaatttgctaccacagtataacttagaataatttggcatacgtgatcaaagaattctttaacatattatttcatatttttatatttttgaaataatgtatcagagagaaaaatattgatataagagaaatggtggataattataggagaaaaacccttgaataaggatgaggagtgtagtgtactagtgaagaccttagacagaggtacacatttccataaggaagaaatccatctaccctaaaggagggaaggtggaacatggatatagatgcaattgcagagtagatttgggatgggcagataaagtggttctcttctgtttgcctccacttttccagtgaaatcgaggtcatcatctcagaacagaaatgaaaaggcagtgttggaggtttgagaagaatagacggagatgaaattttctactgggaaaatgaattaacattgcagtgctgagggctctttggccttacgttcaagggaagatagttaacataagtgtcttctcttgaaccatggtcaagtgtttagatactgtagtagagtacatgagtgtttggtgtagccagggttggggattgccaatgaggaaggtagaggtaaataggggcaaggaagctgagagtagttcaaggaagtggttactctgatggaccatgaaatctaagctgagaagtgaaaacatgaagaagttaatggaaagtggaaaatgatgttaatcgattgtaagtcccacagggcaaaaaactgctagtgtgaggacgctaacctaactgagttagaaatgtgggggttggggagggcagagagaatggaatgccagaaaccaaaattttcaaggtggtacagttactggaattgttaaagactctagtcatacccctgaacaggtggctgaggtggagaactgatgagctcaagaaaccgagaggccaatgagttgtaataatctcattcatgggctaatccatccaacatcatattggctatgagcaattatgatttagggtaggacatgctttgttcttcctgtgctagttttatcacatacaagttatagccatgaaagtgaagcgctgtgaatgagatagtgtgaagcaatatctaaatttttacaagtgaagtgttatttaaatgaaaatttcttgaaaaattgcttttcttaattttataaatctcctatttagaaccgaaaactaaagagcctggcttttctgtaataacagaatgcctcatttttggtctacaactctaaattgaagtggtattttactactaaatacctgtaaattattctctttttctttccataattaatacataattttctgtcattgctgctttccaatcctaatcatatgtattaaaatacatttttttttcttttttttgagatggagtctcactccattgcccaggctggagtgcagtggcttgatctcggcttactgcaagctccacctcccgggttcatgccattctcctgcctcagcctcctgagtagctaggactacaggcgcccgccaccacgcctggataattttttgtatttttagtggagacagggtttcaccatgttagccaggatggtcttgatcttctgacctcatgatccacccgcctcggcctcccaaagtgctgggattacaggcgtaagccaccgcacccggcctaaagaattttttattgctgaaaagtatcttactttcccttgatttttcattttctctgggatatttctccaggatatttacatggggaagaaaatggccttttcctccttgtagatgattcagttaagaaaggaatagaattggcttaaacctcattgctccaaaacgaccctaagagctccaagaaaatttttccacattcatcaaaatctgcagtctgaagcagctgacaagggcacctgaagcaatccaacaagtcagcccgtttataattgaaggcttttattgaactatttttggatcctgttatatattatctccacaagaaaacaaccagattaaaatgaaatactacaatggaacaacaaaacttcagttttatttacataaaaggcaaccttctaaaaaagcatccctaatctctcaaagacaatgataaggcaatctggcagcttgaaaagtcaaagtgactttcaagcattgttgtttaaactgacaaaaatttctacagatgccaatgcaaaattaaaaaaaagaagtaacacgtttaaaatatatacactttagagtttatatagaataaaagctttttttgaacttttctaggattgaaaacaaaagcaaacattgctcttccaaagccattatcgagcagaaaaatattcatacagaagtaaaaatctacagtgcaaattaaagcagagagaaacaatctagaataaaacattatttcaaataagataatgtatgcatgagtgagcatttcctctgaatccaggtgactagcagggcatgatgggaagattacacttcttgtcatcctatacagaaacaccaagaaaaggtctggtgtctctccaggggcaaggaccaataattcttcgagaaaaggcatactgagaggattctttaagtcaaatggatctaagatcaagtccaaagtgatcaataagagctgaaagatcagtcaagtaccaaatactcaaggaaactcatcaacgtagaaacaagaaacagggaaggggacttgtgaacaaaaggtgtgggcaatgaggaattaggaacccaatcagagcctcgttgggaaatgaggaatgtggcaacaagcatgaattggttcataaaaccaatgatcttgtgaaacaggagctgcttctatcttttgctcatagtgacctatctgagccaacagatggttggatttgcttggaaatagcatgagaagccaacattcctgacataggtgttggagaaagacacactagaatcttggttctgcaacttgtagctgtgtaactctgagccagttgtgtaattcctctgagcctcagtatcgcctacaattctaaagcattcagtgagttgggagaattaaagtagataaggtgcgtgaaagtgctttacacatggaaagcacacaatcagtatcttcttccattaggccaatacacctgtatattgcttattgtttaatttacaccaattattttcaggaatttatttgagcacaaggaagtgtggaattaagaatctgtgttgtatctgactttaaaaaatacagagaagatcgttcattttttttatgacattgacaatgtcaacgtttaacacaaacaattctattttaaaatcttgtatttcctgatcaatctgttgggagtgaaaattagaagagagggtagtaaacaaagtaagaatttgcaaacatagttgaactcagataataaatacctatatcctctacaggtgcccttttctcataatagaaaagagatgagaagacatgaaaagtgaaagcttaaaaagacagtacccatgtaaggcaagagtagaatctgttcagagaggttacttgtctagggctgcttagctagttattgacaggggctttgctagaactcacatctcttgtggaatgtgtgtctaacatattctcaccaaagaagaagcgtatgcattatttcctcagtgaagccctttcttggtcccaaaaccaagctgtctgctctgtatgctctcatagctttctctatttcccttttcaacacagtcatcaggcatattgttaccatgtggataatggagtgagtggttaaaagcataggttctggtgtcaaactgtttgaatcttgtctctccaaattattcaaacgatttaagcatccaaaaagaataaaagcacttaatttacagagatgtagtgaggagacaataaacctttacaacaatgcttgacacagtgcaataaatgttggccatttgtattattagtaaggataattaaggcaaggagtgtttaatactggatgtccaacacagagtggtgctctccccaaagatagcacaggatgtgtcccctgtcaaaccctcagaggaattgcaaacctataaaattaataaactttgaaagtagttgtgtgattatgtttgctaaataaaggcagttccaattggcacaaatttcagttttcatggtttagtttaaacaaactcagtgccctaccaacatagttaaaatttcagttaccacagtctatcttctgtggtgaagagcctattaaaccattttctgatttttaaaagtatgttttcttcttattgagttctttatatatgctgtataaaaatactttttcaggtatatattttgcaaatattttctccaagactagtttgtctttttattttcttaagagtgtcttctgaagagtaaaagttttatttctgatgatttctaatttatcaattttttcttccatagttcataatttctgagtccaattgaagaaatgtttgtctaaatcaacatcactaaggtgccctatgtttcttccaagggttttatacttgcagcatttatgttgaggtctacaattaatttcaaggtaacttttgtgtaactgtgaggtaaaagttgaggtcttctttatctccatgtgaatacccaattgttcagaactatttgtggaaagactatccttcccccattcattatcttagcacatttttgtcaaaaattgattgattataaatgtgtaggtatatttcaagactctttattttgttccactggttgatatgttaatctttacaccaataccacattctcttgattactatagctttatggttagtcatgaaatcaggaggtgtaatttccccaactccattcttttccaaaattgatttgacaatgctgtaatgaaatttagagccagcttgtcaaattcaacaagaaaactgcttaggtttggatgaggactgcacttgatctaaggatcaatctgggagaaatgacattcttacaaggttgagtcttcctgcccatgaacttggtatttccttccatttaattacatctttactttatgccacaaaagtttagttgtcagcacacagatcttggatatatcctgttaaacaagtatttcatatttgtgatgatgttgtaaatggctgattttaaaaaattcaatttccaacattcattgcaaatacataaaaatataactgattttgcatatggacttggtacaccatgaccttgctaactttagttattggttcttgtagttttgtatttttgcagattccttttatctcatgtagatgacatgtctgcaaatagacagttttacttcttcctttctgatttgtatgccttttatttctttttcttgccttgttgcacttcctacgacctccagtataaagtgaatagaagtggtaacagtagatgtcttttccttgttaccaatcttgggaaaaaataatatggtctgtcatcattaagtatgattttagttgttggtttttctttttctggtgtcttttctttttaaaaaagtttttaaaaaacatttttgctgaaatataaatcacataccataaaaatcacccattaaaatgtccaattcagtagttttggtatactcacaaagttgtacaaccatcactacagtctaagttgttttttaaaaaaattttaattttttattcccataggttattggggaacaggtggtgtttggttacatgaataagttctttagtggtgatctgtgagattctggtgcacccatcacctgagcagtatacactgcacccaatttgtagtcttttatcccccacccccttcccacctttttctcctgagtccccaaagtcttttgtatcattcttatgccatctgttctttattggctctttgaataggtgttaaacttttaatgctttttctacatctactgatataatatgatttttcttttttagtcttaatatagtgaattacattgattttttaaaaattttgaaccaactctgcattcctgagataaaccctacctgaccttgatgtgctatcctttttatatattgatggatttgattggctaatattttgttaagtgattttttgtgtgtgtctgtagtctgtagttctttttctcttgcaatattaatatctagttttgttatcaggataatgataagttcataaggtgacttggaaaatgtttctcttttattttctgaaacagtttgtgttgaaatggcattatttctttcttaaatgtttggtagaattcactggtgaagtcacctggtataaaatgcacttgtttattcattattcctaaactaattccataaaaacattgtggaggcagttgcttataattctttcttccagcaaatgctagcagttacttgcatacagagattgccaaataagtatctgtgaaagcaaaaactaaaatgttacatacctttgtttttttctgcctcacttaaaaatattttgtgtgtgaacaaacaatatgagtgatgatttatataggtatatattatacaaaattaattttaaatgaagtataatattaagggctatttttaaaacccaggtataaggagattgctacttattatttaacaaacatagatattcagcatattgactaatgttcttcatttaatttggtggttaattaaaccatttaggttatgagaacaaaatcaaagtactgtctagttaaaaacgtttcaaaacaggtgctaaaatatgggactgaaacaaccaatagctatttaacggagaaagattacaaaatcatttcctaaataactttcttctttccttcttgcaagatcagatcaaagcaaaaatcagattcccttcatgttcatgcaagttcctgttcctgtgatttttaaaaatctgattcctccaaaaattgtctttcaaaaactgtcctatttatttctagcttcttgaacaataacaattaggtttataaaaattggacaaattttgttttggctctattcattagatctcacagggtacttcaaaaataaaccaattccaacatctggattttttatcaaagtgctgtctaattccttggccatatgaggcatattttaaaaagatggtacagagcagttaaaaatcatgctgaaacaccactctggaaacttttatagtattttattttcagcttataacctagtaaatgcagataacatggaaattctacagagcctgacaaacgtaatttgcttaccccaggtaagctttttacttaatttgagctactatgttggggttattttattcttagctatattttatgtgaaataaactaatttgcatttttttaaaaacctgtgttaaaatatattttcatccattaggtcctgatcaattatgacgccttttcttcttcgtattgtcaacacttaacacgctgcccagtttacactgtcattactcaataaatgctaaacttgaacatgaagtttaactgaactaaactggtcttgtagcaatttacaaagtaacccagaaggtcagatatcaatgtgacttacagtgaaggaagtaattacacatttttctttcacttgaagtggttctaaatatacaaatatatttactttgctttcctcaggtaggcagccctttacctaactaccatgaaaagagtttttaaaaactttttgttaaaataacaaagccctcgttgcagaacaccaaaagccacatattttaagatatcaaaatcttcaatatttttagctctttagaaatagaaaactagcaaaagatagcaccatcagcaaataatatctcagccccttccttactactcccccaccatccttcctcaggattcagttccagtgaatgatcatcagaagcaaaacctgaagcaaaaatctttcaaaaattacaacaaataaggtacattcttggcaagtctcaattttgtgataactttctcctcaagtttattattataaaactatcttgtaataaggttatttggggacccccttagatggtctgagactaaatgatttctacttcagaaaaaaatactctataacagggttttggttatttaacacagcagcattcaaatagcaggaattcaatttttgttcaagtaaatactatctgctcattaatttgtttaatcacaaaatgatttcacaaaacaatacagtttgtgacttcttaaagaacttctggtgttcagattgacttttaatacattatgtctcacactaatagtcactctatttttagaaaagttaaaatcaaaataatacctattacacctccattctaagggaaaaaaatatgtttcatgaggatgttgctgaagatgttaattaaccatattacacttgtcctcttggtgagaatctcttgtaattttttctctaaagatttcaatccactaatttttgaaataatgacttttaaaagtttattgcactgaatcttgttttaattgtgatgctttttataaattgacatttgctactgaaaaatgtggagtcaaatataggtccttcagcagaatttatccaacgcttagagtgtgttgtgttttcatgaacactaccactagcctcaccttattttttcttttattttctgttagctgtgattccttactttaaaagaatcttgcattttaaaagcaaccttgagcttccaatattttctctcctaatgatatgaaacaataaaaataaaaaccaaaaaccccacaccctcagcataacttaaagctagaaaaatgacaaagtaactgtgagtaaaagaacaggtaattatttcaggtaagattcaccaatggttcagacaaaattagtgaacaaaagtctaagaatatgtgcatagtctcaaactatgtctcccaagatattttacctcttagaaatgaaaaatgattaattttacagcacagaaacctggcagataccatctttaaaaagtgatcaatgtttgcatcaccaataacaagatattttgataccatgcatcctttgatataatgcatctgagaaaggcacaatatcacttctgcattattcttgccagaaatgcataacctcaatctaatcataaacaaagtgagaaaattctacaaaataaccagcagctagcacacttcaaaagcgtcaaagtcatgaaagatcaggaaagacaggggaggtgtcatagattgaaggagaataaagagatataacaactaaatgcactgtgagatcctgcattgggtcctagaacaacaagaaggactttaatggaaaagctagtgaaattaaaataagatttgtagttatttaatagattgtgccactgttaatttcctggttttggcaattgtactatagataaataagatgttaacattaggggaagctgggtgaaggacatatggcaattccctgtactatttttgtaacatttcagtaagtgtaaataaaagtttaaaaacaaaaatgttaaaaaggcatcttcaatctttttaaaataagtgggattttcataaacaattaccgtctgacattcttccgatttttcctaagctcatagcttcctcgtgttatcccctttgactgcctcagaaaattcttcatatctagtgccaattcaaatattgtctctcttccataaaagatcccgcttcctacagacctcagatctcccagcattgtaccctaaagtagaagtttaccatgcatgactagatagttttctagttctttttttacctgtatttctcattgtcactgcaataagaaaagctcccagaatgcagtgacaaagttacatgtcttttcatgattttccccagcactgacctaaatatacagtaaatgcttgttaaatacatgttgactcattcactcataaattatttaaggaaactagagatttgtaagttcacatcatccattttacagcctctctgtgaaatcagacatcaaatacaggactgaatgggccattcgctataatctaagtatggcaattctgataatttcttattctcaggaagtctctaaaatgtaaaatgtatgatacttccttcaacttcataaggtagttggggttgaataaacaccagaatccatagaaataacaggcctaaatttatagaaatataggcctaaattataaatctttaaaaggtcattgaaaactgttagaattccgcattcaatattaatatgaaatgtacaataacataagcaattgtcacaaataagattcaaagatactgatgtttgatgagatattttccatgacccggggttgcttccttagagtattcctaggatgtctactgatctgttaaagtcatgcaatgggaacaaatgtccattttctttgccaagaaaataccatagatgaatattaaaaacagttatgtaagccaaaactcacatctgcacacacttaaaatgtagcccttttttaaaataataatttgtaatacattctgaaaaaaaaaaacaaaaaatgttgtacaatgctctacacctggctgggtaaccagtgtttttagccataagtgcagtgatacaggctatgtaattactgaaattgattagtgtactctaaattgtggaaatatgtatgtgtttgtatattagtaactgtttttggcatctatttcaggcttgtttatattatactatgtgtatatatatacatatatgtagaacacaaagttcaaaatatactctactgatgtaaccaaccaattaaaggaaataaaatctgtttaaggggaatataatgcatggaacttaacgggattttctacacaatctggggcttccaatacttaaaaaattatcaaattattaaacttatatatataattatatatatatatataattatatatatatatatatatatatatatttttttttttttttttttttttttttctgagacggagtcttgctctgtcgcccaggctggagcacagtggtgcgatctcggcttaccacaacctctgcttcccaggttcaagcaattctcctccctcagcctcctgagtagctgggattacaggcatgtgccaccacacccggctaatttttgcatttttagtagagatgaggtttcgccatgttggccaggctgttctcgaactcctgacttcaggtgatccacccacttcagcctcccaaagtgctgggattacaggcatgagccaccgtgcctggcctaatattgtttctttaaaaaaacgtttaaaatgtcactaattcactaagaaggtatcacaaacaatgctctaaaaagcttttttaaaaccaatttaaaaaatatgtgtggggaaaaatatattttggtctgatattgaaaaagaaatgatttgcaaaatttttaaaatatttaagtagtcaaaattcccaattcaatggaatatttagcatacatgcatatataatattattttaaaatatttctatatcattttatttttaaaagaatgattactacagggagtaatgtagtatactacatcctactacagtaggatgaagaataatttgtatcttaaaaataggtatttaaaaacatagatcacttttcctatccatgttggtttatattgttgttataaaaaaaaaatcagatgtatggcgtaggacacaacaaagtacagtcttccttaggtacccacaggggattggttccaggactccggtgataccaaaatccaaagatactcagcacctttaaacaaaatggcagagtatttgcatataactatcaacattctctcgtatactgtaaaacatctctagagtatttgaaatacctaacacaatgtaaatgctatgtaagtggttgttatactgtattgtttttacatttgtattactttttattgttatattgttatttttatatttttaaaaacatttttgatccacggttggttgaacccatgagtacagaacctacagacacagaagacagattataaactgaaaaattacaaatgctcatgtattttccctggtacatttgattcttcataggttagatttgttttgaggagtcattttccaaaattcaccagtttattaataacatataccactgtgaaaaataaaatatgttgacatatgtggcataattaaaattaatccttcatagggaaaactattaagaaacaggtattcagctaattatatatgtagaaaaattccaaggaatctaccaaaaatagtgactagaattaataaatgagtttagaaaggtcacactgtataatatcaacattaaaacatctattatatttatatattagcaaagaacaattgggaattgaagataaaatcatgattcaatatcatctaacaaaatatgtgcaacctctagatgctgaaaactataaatgctgatgaaagaaattaaagaaaacctaaataaatggtaagatcttccatggtcatggatcagaaaactcaatttcattaagatttcaaccttaatgtagattaaacacaaatttaaaaatatctcggtaggattttgtgtagaattcattatgctgattctaagaaaaacaaagaaaccatcataggcaaaatgatcttgaaaaagatcagtgttggacaacttatactacctatctctaagactgactataaaagctacagtaatcaagatagtgtggcattgtaaaaggatagacatatagattaatagaagaaaaacagaaagtccactagtaggccacatatatgtggtcaaatgattttcaacaaagctgcaaaggcaattcaatggagaaaggatagtcttttcaacaaacaatacagaaacaattgaatcttaatccatatattgcaccatccacaaaaatctactcaaaatggaccacagaccaaaaagtaaaacctgaaactgtaaaattctagaagaaaacaggagaaaagctttgtgaccttaagtcaggcaaagattttttatacacaacaccaaaaacatcatctataaaagagtaaactggtaagtcagaattcataaaaattaagaatctctgctctttgatttgggagaaagtgtttgcaaatcacatatcttataaacaacttgagtccagaatacataaataactctcaaaatttaataattagaaaatagcagtaaaaaatcagaaaaagatttcaatagatacttcaccaaaaaagatattcagatgacaaaatatacacaggaaaaggtgctcaacattattagtcattagggaaatgcatgaatggtgagaaatgtgtatttggatgactaaaataacattattaactccacaatatgaagggtgcaacctaactggaactctcatacactgctggtgggagtgcaaaattatgtagctactttgggagacagtttggcagtttctaataaaatttaaaaatatacttaacataaagctcaacaatctcatttctttctatttactcaagttaaattaaagtgcatattcacacaaaatctttatgtgaatgcttaccaacccagatatttcccagctggagaatggataagttttgtactcccatacaatggaatactactaagcaataaaaaggaacagattacagtgacacacaacaacatgagtgaatctctaatgcattatgcaaagggaaagaagccagactcaaaaagctaactactgaatatttacatgacattccagaaaaggagaacctatggtcacagaaaatacatgagtgattactaggagctgggacatgagaaaagaagtggagctgatgacaaaggtctggagaaatgtttgaggtgatggaactgttcttcatcttgatgtggtgatggtttgtcaaaacttgcagaactgcacataacctatataagttatagttgttttaaaaagaggaataaatgaagagttagaggaatacaagaaagagcttgactgcttctgagttggtgtggaaaggaggaaggcagggacatctttgaggaagaaagatgagttaccaagtcttccaggcagaggggaaaatgtgtgtgaagccacaaacggagattgtttacagcctatttatggaaaacagagttgtctgggagtgggtacagcacagactgttatctgtggtgggagagacagttaagaaaggtagaagacatcaattcacacccattacaatggttattataaacagtgttggcaatcatgtggagaaactggaacccttgtgcactgccgatgggaatgtaaaatgatgcagatgctatggaaaatatatggcagttccctgaaaaattaaaaacagaattatatcgaccaattcctacttctgagtatataccccaaagaactgaaagcagaaactagaacagatatttacacatccatgttcacaaaaacattattcataatgtgacaaaaggtggaagcaatccaactgtctgtccattggcagatgaatggatgaacaaaatgtggtatacacatgcaatggaatattattcattttgaacaaaacaggaaattctgacacatgctacaatgtggatgaacttgaagacattatggtaagtgaaataagtcagtcataaaagaactactactatataattccattcatatcaggtaccctagagcaatggtcctcagcctttttggtgcaggtttcatggaagacaacatttccacaggatgagggtagaaggatggttttgggatgaaacagttccacctcagatcatcaggaagtagctcacctgccactcacctcctgctgtgcagcctggttcctaacaggccacagacaggtacgggtctgcagcccaggggctggggacccctgccctagagcatcaaatacatacaggaagtaaatgatgcttgccaggggctagagggagagaaaatgggagttactgttcagtgggcacaggtttagttttacaaaataaaaaaaaattctcgagacggatcgtggtgatggttgcacaacaatttaaatgtacttaacaccactgaactgtacagtaaaaaaatagttatcataacttaaaattaattaattaaaataaatacataagaaagaaaaacaatgaaaggtacagaggggaaatgaaattatgcaaatctttggccagacaactaggaagctgtggcaacttcactttttcttgggctacagcactttgtaagcttttgagcaagggagaaaatgccattagctcacaatctacctcttccagaaagttctgccagattctgcctgttgcccccagatgtcagacacctccctgcatttcccagggcatgcagtccagcatatctagatgatggcccttatttctgttcaatgtgattgcagtttgttccatcatccctgccctatcaaaattcatctccttgagatgaattaccaatgcctaactcagctcagcaatgagatttattttttcagcaagatccctatgtcaggaggacagaggttgtcttgttcttaccttcttctctttgaggttagattttcctgtatccctcagaggcttcaaacttcctgcctgctctgtcttggggacattaccattctcttctctcatctctatcagtctcagggcttggttttccttggcagatggatggtctaaactcagagaagcccacatcttcgttgacccccattaagatctcagaagcagtgatgagagccctcagtgcaggctgtagggcaggcagaacttctaacaagaagccagtgagagcacagcctccctcccctgatagaaaggtgacttgggcccagagggttagagtgtctgagattccccaccacaatctcttaggtgggggtgaggtgagatagtgacatcacaaccacactgcctggctcagttcctgatgtcagctaatgtgatgccagggctaaagggccagcacaccttctttgtgattctggtctcccaggggcagaaaataggaagcaggctaaagatgccctaggacttagggacaaggcaacagtatgacgaaaggttgacttctgtgcatcactgttcagcttacaaagtgcataatagagaacatttcgaaatacagaaaaatacaattcaaaattcacatatcccatctcacagagaaatgaactagcatattttttccatgttttcctgtgtgtaactatgatgattaatactgagtgtcaacttgactggaatgaaggatgcaaagtattgtccctgggtgtgtctgtgagggtgttggcaaaggagattaacatttgagtcagtggactgggagaggcagaccaaccctcaatctgggtgggcaccatctaatcagctgcctgcatggacagaataaagcaggcagaagaaggtggaaagagcagacctgctgagtcttctggccttcatctttctgccatgctggatgcttcctgcccttgaacatcagactccaagttcttcagcttttagagtcttggacttaaaccactggcttgccaggggctctcaggtcttcagccacagactgaaggctgcactgttggcttccctacttttgaggttttaggacttggactggcttccctgctcctcagcttgccacaggcccattgtgggacttcaccttgtgagtcaatactccttaataaactccccttcatatatacatctatcctattagttctgtccctctagagaaccctgactaacacacgaagcttatctatggcttactttctggctctcatgacccctatcaaatccatcagaaaatcatatttactcttacttaaagtatattttaaaaatatatccagaatatgatcacctccccagctaccactctggtctaagccaccatcatttcctctcatctggattaccaaagttgccttctcattggtttcccacctttgttctcatgcagctagaatgatcttttaaagcctaagtcagatcatgtcccttcatggcataataccctcttactctctcattactcagagttaaagtcaaagtcattggaacagcctcaaaggccctacatgaccaggccttggaatgcctctaatgtcttttccaactcccccatgtccactatgttctcgtcacactggcttccttaagtcctctagcaatgccagccatgctcttgcattagggtctctgcactagctcttccttctatcagcaatttcttcctccgaatatcaacatgcctcactcgactccttcaaatttgtttgaatgttaccttcttgatgaagccagctttggccacactatataaatggtaccagccctggtactcgagagtctccctgaatcttctctatcatttccttttcaatagcactttgacacttaaaaaaattctatataagttacttatgcagcatgttcatggctaacaatgtatctctcctactagaatgagctctgaggggacaggaatatatgccattttgctcactgctatatcctaagtgcctagggccattgtacaaaaattaagcacaaaatgctgaaagcaatgggtgtgtgccattagtctgttaactgttccccagtacctgttcttcatttcttttcaaaatagtctccctgcaacttttagcacagtgcatgcaaataggtccctgcttccccaggtgtgcccctgggactgttttctccagtaaaatgtcagaatgatatgcacaacttccatggcaattccctaaaaggaaatatttgtcttcctcatctttttcctctcttcctgctggttaagaaatggtgtccatcagaagagcagcctttaaagcagagatggagacagtatgttgaggatgactgaggaatctcactagtcagcctaggttcctaagtgacctcatgaaagagaaccatttgatcctagccctgggccatcctaatacatctggattcttacgcaaaacagaaataaactttcttatttcatttctccactgcattatggggttccctcttacagcaacttaggcttactctaactagtatataaagaatcacaaataatttttcttttttgatttatcagtatagtaatttatattattaataatagtgctcctaatatcaaaccatctttgcactcctggaataaaatccatgtgattatgatgtacaatattttaaatatgctactagattctcctgcttaatatttagttttttacaatattcaaaagtgagattaatatgtttttagagagtttttttttttcagttttgacactgatattatgctaactaaggaatagattactaggtcaaaagatagggatatttttaaggttcacagtatagataaccacaggctttcaggaaggttgtaccaatttatattctcaacaatagcattttagagtgtttatgcactgcaccctaggcatcttggtattattaatttaaaattacgcttggtaatatttaaactaatttactttttcaatatattaaaaaatagtatgtcttaattagcattttctttattacttatgagaatgaagaggtttatttaagccaactgcagttttagtggtcatgtactttctatttatttttttaccatgtctcataatgtattcaatttagttaaattactcaaccactttcaatttttaatttatttaatctgcacaaagctggatcaggcaaaccaggcccatagagaatttttttttccattatgaatatgagttagaaccagacctgactctcaacacagaacccttccactatactagacccataatgtatctatgcagctttatgcccatcagctcattctattgtcctcccctcaaagaaggtctaaacataggaggcgggagtgtgaaataagaggctctgtccctttatcccaacatccctgagtctcttaataaagagaaaataagtttggttctaagtgcataaaatgctattcgaaatgttgatgtggtgtggaataaacatcagaaaggctgcttggaatattaaaataattacagtctagctatctataagctaaatttggtattactgtcaaaaaagcactcatttaaaatatatatagtgactacaatgatattcaataattaaagtacagaaaacaaaaaaagaaaaggtacatcgtttacataaaaagtactcaacttagcatgaaagctgggacatatttaacagtgaaagggatagcaggaaatgctaagtcacacaagatactgggacaacaggtaaaagtgagaatgttttggtcaaattaaaatgtatagacaccctattaatggtaagatatcaaagtagtaccataagtaattatttctgttcttatttgtaatcatttcatcactgataaagatcccagtaaaatatattttttcattttattaactttagtgttataaaaaacagatgcactgtccaattaggctattacaaacttagccatgaagttgaaaggatcaaaagatttatacaggcaaagactgggagtggcatcagcaagatggtggaatagattgtctggcatcactcctgccaaaaaatataactaaaaactatccaaagacaagaataccatcctgagttcaccagaacttggaggaaagcagagaaactccctgggcccccagaatcaagagaagccatgactggtaagagaaatattcatgttggactatgctgccctctcccacaagccatcataatgtccctcacacaaaatttctctagattcagtttccaaggtaagaggttgtagacattagatctcctccacagtctgggaatcttcacaggaagaccattctggtcttgtcccacaggaactaatgggaatgccaggaatactgaaccaaactggggtgaactggggacaaacagccggcactgattacttgaactagtgcatggatcttggcagctactctgtacttcaatcagtgaggaagccatattaaagagactgcttgctgctctattgcagcagtggggcagaatctgtgggaaggctcgaattcctggctagatttttccacaaaccccaactgctctatggagccttgacctgacccagaaacaactaaaaggttaagattaagttctggtgcctgcttaagtcttccttacactaggaaacaatggcaggtcagcaaggtagttcaaaggtaatgtttaacttccaattctcactataagtcttccccagaccagaaaacagtggcaggcagtgattttgtttcagagaagcatttaagttctggagtcaactataaatcttccccagaccagaaaaaattggcagggcaatgagtttgttccactgcaatgttttagttctaatgctcactataagtcttccccagaatgggaagtaacaacaggccagcatttaacttctgatgctaagtagtaaaggtctgataccaccaaagaatacgtgcataaaatagagaaagtggatgtctcctcaaatgtgcagccaccaacataaagatgcaaggattgtgaaaactcaggggaatatgacaccactgaaagaaactaccaatagactcagaagagctgacaaactgtgaaatatcagagaattcagaataatactttcaaagaatttcagaaaatcaggccaggcgcagtggctcatgcctgtaatcccagcactttgggaggccgaggcgggtggatcacgaggtcaggacatcaagaccatcctggctaacacagtgaaaccccgtctctactaaaaatacaaaaaattagctgggcgtggtggtgggcacctgtagtcccagctactcaggaggctgaggcaggagaatggtcagaacccaggaggcggagcttgcagtgagccaagatcgcgccactgcactccagcctgggcgacagagtgagactccttctcaaaaaaaaaaaaaaagaacaaatttcagaaaatcacaagcaaacatggatagaaaactaaaagaaatttggaaaacaatccaggaacaaagtgagaaatttgacaaggaaattgaaataaataaaaaaccaaatagaaatcttagaaaagataatacaataatagaactgaaaaactcttttgaaagtttcaacagcagacttgacaaaacataggaaagaattagtgagcctaaagacagaacatataaaattactcacagaaggaaaaaggaaaaagaaaatgagtgaagaaagcttacaagatttatagggaaaacaacagaatatacattcatctcattgccacatagaacatactctaaaattgaccacataattggacaaaaaacaatcttcagcaaaggcaaaagaaccgaaatcataccaaacacactgttgtaccacagtgtaataaaaatagaaggcaagactaagaatatcattcaaaatcatgtaattacatggaaattaaacaacatgctcctgaatgacttttgggtaaataatgaaattaaggcagaaatcaggaagttctttaaaactaatgaaaacaaagatacaacataccagaatctctgggacatagctaaggcagtgttaagggggaaattatacagagcactaaatatccacatcaaaaagttggaaaaatctcaaattaacaacctaacatcacaactgaaagacttagagaagcaagaacaaatcaacctcaaagctagcagaagagaagaaataaccaaaacgagagctgaaatgaaggaaactgagacacaaaaagccattcaaaagatcagtgaatccaggagtttgttttttggaaaaaaaaaaaaaactaaaaagacagataggccactagctaaactaataaagaagaaagagagaagatccaaataaacacaattagaaatgactatgggaatgttaccactgaccccacagaaataaaaataaccatcagaaactcctatgaacacccctatgcatacaaactagaacacctagaagagatggattaattcctggacacatacatcctgccaaggctgaacaaggaagaaatttatttcatgaacagaccaataacaaactccaaaactgaatcagtaataaatagcctaacaaacaaaaaaactccagggcctgatggattgacagccaaattctaccagatgtacacagaagagctgctaccattcctactgaaactatttcaaaaaattgaggaggagggactcctccccaacgcattctatgaggccagcaccatcctgacaccaaaacctggaacagacaaaacaacaaaaaaagaaaactttaggccaatatacttgatgaacattgttgcaaaaatcctcaacaaaatactggcaaactgaatccagcagcacatcaaaaagctaatccaccacgatcaagtagacgtcatccccagaatgcaaggttggttcaacctacacaaatcaatgaatgcaattcatcacataaacagaactaaagacaaaaaccacatgattatctcagtagatgcaaaaaaaggctttcaataaaattcaacaccccttcatgttaaaaactctcgataaaccaggcattaaaggaccatacctcaaaataataagagccatctataacaaacccaccaccaatattatgctgaatgggtaaaagccagaagcatttcccttgaaaaacaaaacaagacaagaattccctctcaccactcctattcaccactgtattggaagtcctagccagagcaatcaggcaagagacagaaataaaggacatccgaataagaaaagaggaagtcaaactttctctgtttgcagacatgattctatatctagaaaaccccacagttttggccccaaagctccttcagctgataaaaaacttcagcaaaattttaggatgtaaaatcaatgtactaaaatcactagtattcctgtacaccaacaacagccaagccaagagcccaatcagaaagcaatccattcacaatgccacaaaaagaataaaatacataatatacctaggaatacagctaaccacggaggtaaaaagtctctacaatgaaaattacaaaagagtgcttgaagaaatgagagaagacacaaacaaatggaaaaacatcccatgctcatggattggaagaaccaatatcattaaaatggccaaagcaatttataaattcaatgctatacctaccaaactgccaatgatatttttcacacaattagaaaaaactatttcaatattcatatgaaaccaaaacagagcctgaataccccaagcaatccaaagtaaagagaacaaagctggaagaatcaccttactcaacttcaaactatactacagggctatattaaccaaaacagcctggtactggtacaaaaacagacacatagaccaatgaaacagtatagaaagcccagaaataaggctacacatttataaccacctgatctttgacaaagatgacaaaaataagcaacagggaaaagactccctattcaatgaatggtgttggaataactggctagccgtatgcataagactgaagctgaatcccttccttaaaataaaaagaaaaatcaactcaagaataattaaagacttaaatgtaaaacctataactataaaaaccctggaagacaatctaagcattaccatcctggacataggaacaggcaatgatttcatgacaaagacaccaaaagcaatcacaacaaaaacaaaagttgacaagtgggctataatgaaacttaagagcttctgcacagcaaaagaaactatcaacagagtaaacacacaacctacagaatgggaaaaaatattcgcaaactatgcatgtaacaaaggtctaatatccagcatctataaggaacataaataaatttacaagagaaaaactaccccattaaaaagttggaaaggacatggacagacacttcttaaaagaagacacacatgtggcaacaagcatatgaaaaaaagctcaatattgctgatcattagagaaatataaattaaaacaacaatgagataccatctcacaccagtcagaatggctattagtaaaaagtcaaaaaataacagatgctggcaagggtgtggagaaaatggaacacttatacactgtctgtgggagtgtaaattagttcaaccattgtggaaggcagtatggccattcctcaaagagttgaaaacagaactaccattcaacccacaaatcccattaccaggtgtatacccaaaggaatataaatcattctaccctaaagacacatgtacatgaatattcactgcagcactatccacaatagcaaagacatcaatcagctaaatgttcaccaatgacaaactggataaagacaatgtgatacatatataccatggaatactatgcagccataaaagaatgagatcatgtcttttatgggaacatggatggagatggaggctattatccttagaaaactaacacaggaacagaaaaccaaagaccacaggttctcacttgtaagtagtagctaaatgatgttacctatgcaacaaaccttcacatgtacccccaaacccaaaataaaagtaaaaaaaaaaaaaaaaagacttaataggacatcagcaagtgaatgaatctccacataacagaaattcccaagacagaaaaaggcccacaaagcatatttttaaaaaatgactgaaaatttctcaaatcccaagaaaaattataccatccacgcacaggaagaagtaatcaatcaaatttaacccaaaggggaaatccccaaggcacacactaatcaaattagcaaaaatgaaagacaaaaaaagaatactcaaagcagcaagagaaaagacacatatcatattcactggagccccaatacggctttcaatggatttctcaacaaaaaccctgaaggccagaagagagtaggatgctatattccaagtttaggggttgggggtggaaaggagagactgacaactaagaatacatacccaacttcactattcttcaaaaatgaaggaaagataaagattttcccagacaaatcaaagctggggttattcatcaacaccagacctgtcttacacaaaatgctaaagggagtttttcaatcagcaagaaagaaatgaatgctaacatgtaacaagaaaacatctaaagatattaaactgacttggaaaaacaagaaaacagacacattcagaatagtctaatactggaatggaagcacttaaaccactatgtgttcagcatgcagactaaaagacaaactattttaaaataataactacaataattggctaagaggcaatataagaagattcaaattgaagcatcaaagagtcaaaaatgtggtgaaggggatgctgttaaagtgcagtttttttcttatttttcttttggttgtgttcaaagttaagtcactatcagtttaaaataacctcttataactaaaagatgttttttgtaagcctcgtggtggccacaaagcaaagtaaatacactaaaaatagcacagaatcaatagatacactaaaaatagcatagaatcgaaacatactaccaaagaaaatcagttaaccgcaaaggaagacagtaaaaaaggaaggaaggatttacaaaacaatcagaacacaagtaagaaaatggcagcagtaaactctttcctatcaataataactttgaatgcaaatgggttaaattctccaattaaaagacacagaatggctaaatggatttaaaagaaaacaagattcaactgtacgctgtcttcaagaaactcacttcacctataaagacacacacagactgaaagtgaagagatagaaaaggatatctcatgcaaatggaaaccataaaagagcaggaatagttacacttatattagtttatgttgactttaagaactgtaaaaagagagacaaagaatgttatataacaaataaatacagaaagataatataataattgtaaatatacctgcacccaacactatagcacccaaatataaaaaaacaaaaattaacagaccaaaagggagagactgactgcaatgcaataatagtagtagatttcaacattccactttcagaatggacacataatccagacagaaaatcagcaaagaaatattcaaggtaaactgtcctctagaccaaatagacctaacaagacatttgctctccctctccctctccccatccccttccccctccccctccccctctgatgcccagccgaggctggactgtactgccgccatctcggctcactgcaacctccctgcctgattctcctgcctcagcctgcccagtgcctgggattgcaggtgcgcgccgccacgcctgactggttttcgtatttttttggtggagacggggtttcgccgtgttggccgggctggtctccagctcctaaatgcgagtgatctgccagcctcggcctcccaaggtgccgggattgcagacggagtctcgctcactcagtgctcaatgttgcccaggctggagtgcagtggcgtgatctcggctcgctacaacctccacatcccagccgcctgccttggcctcccaaagtgccaagattgcagcctctgcccggccgccaccccgtctaggaagtgaggagcgtctctgcctggccgcccatcgtctgggatgtgaggagcccctctgcccggccgcccagtctggaaagtgaggagcgcctcttcctggccgtcatcccgtctaggaagtgaggagcgtctctgctgggccacccatcgtctgagatgtggggagcgcctctgccccgccgccccatctgaaatgtgaagagcacctctgcccagccgctaccccgtctgggaactgaggagtgtctctgccccgctgccaccccgtctgggaggtgaggagcgtctctgaccagccaccctgtccgagaagtgaggagcccctctgcccggctgccgccccgtctgggaggtgtacccaacagctcattgagaacgggccatgatgacgatggcagttttgtcgaatagaaaagggggaaatgtggggaaaagaaagacagatcagattgttactgtgtctgtgtagaaagaagtagacataggagactccattttgttctgtactaagaaaaattattctgccttgggatgctgttaatctataaccttacccccaaccccgtgctctctgaaacatgtgctgtgtccactaagggttaaatggattaagggtggtgcaagatgtgctttgttaaatagatgcttgaaggcagcatactcgttaagagtcatcaccactccctaatctcaagtacccagggacacaaacactgcggaaggcggcagggccctctgcctaggaaaaccagagacctttgttcacatgtttatctgctgaccttccctccactattgtcctatgaccctgccaaatccccctctccaagaaacacccaagaatgatcaataaatactaaaaaaattaaaaaaaaatacaatgatacaattaaaaaacacaaataaaaaatggattaaaaaaaagacatttacagaattttccacccaactgctgcagacatttacagaacatttcctcaacagcacatggaagagtctccagtatagactacatattaggtcacaaaacaagtcttaagaaatttttaaaaatcaaaatcatatcgtcttttctgatcacaatggaataaaactagcaattaataacagaaggaatgttggaaactgtacaaatccatggatattaaacagcagacccctcaataagaaatggatcaatgaagaaattcaaagagaaatgttaaaatttcttgagacaaatgaaaataaaaatacaacacattaaaacctatgagatacaggaaaatcagttcaaagagggaattttataacaataaatgcctacatcagaaaagcagaaagccatcaaataaacaatctaacactgcacttctaggaaatataaaaggtagaacaaaccaaaccccagatttgtagaataaatgaaattataaagattggagcaaaaataactgaaattgaaaccaaaaaaagaaaaatcagcaaaacaaaaagttgtttttaaaaaagataagcaaaaactggcaaacctttagctagactaaataagaaaaaaaagagaagagacccaaataaataaaaccagaaataaaaagggagacactaaaattgataccacagaaatacaaagtatcagtagagtctattataaacatctacacgccaacaaaatggaaagcctattaacagaagaaatggataaacttctgggcacatgcaacataccaaaattcaactatgaagaaatagaaaaccagaacagaccagtaatacataatgagattgaagcagtaataaaatctttcatcaaagaaaaacccagaacctgagggcttcactgctgaattccaccaaacatttgaagaactaatatcaattctactcaaagtcaacaaaaaaatgaagaggagagaatacttccaaacttactctacaagaccagcattaacctgatactaaaacccgacaaggacacacacatacacacacacaaagaaaactagaagttaatatccttcatgaacatagatgtaaaaatcctcaggaacatactagcaaactgaattcagcaacacattaaaaagatcattcatcatgatcaagtgggatttatcctggggatgcaaggatgattcaacataaatatatcagtaaatgtgatacatcacattaacgaaaccaagaacaaaaaccatatggtcactttagtagatgctgaaaaatcattcaataaaattcaacatccctttatgattaaaaaaaaaaaacctctcaataaaccgtgtatagtagaaacacttcacaaaacagtaaaggccatatatgacaaacccagagctaacatcatagtgaaaagggaaaaattgagagccttttctctaaaatctgaaattaaacaaggatgctcactttcaccatttctattcaacacagatagtattgggagtcctagtcagagcaattaggcaagagaaaaaaataaggggcatccaaattagaaaggaagaagtcaaattatccttattcacagacaacatgatcatatattaagaaaaacctaaagactccaccaaaataatgttagaaccagtaaacaaattcagtaaggttgcaggacataaaatcaacatgcaaaaatctgtagcaattctatacaccaacagtgaacaatcatgaaaaaaaatcaagaaagcaatcctatttacagcagcgataaaaaaaatctaggaataaatttaaccaaaagtagtaaaagtttctacactgaaaacttaaaacactgatcaaagaaattaaagagaacacaaaaatggaaagatactccatgctcatggattggaagaattaacaatgataaaatgcccacactacccataacaatctacgggttgattgcaatctgtatcaaaacaccaatgagattcttcagagaaatataaaaaacaattctaaaatttgtatggaaccacagaagaccccaaatagccaaagtgatcttgtgcaaaagttataaagctagaggaattgcaccatcaggcttcaaaatatactgcaaagctatcataaccaaaacagcatggtactggcagagaaatatacacactgaccaatggaacagaatagagaacccaccacacctttacagctaactcatttttgacaaaggtgccaagaacataccttggagaaaggacagtcccttcaataaacagtactggcaaaactggatacccatatttagaagaatgaaaccaggaccctatctctcaccatatacaaaaattgaatcaacatggattgaagacttaaatgtaagacctgagagtatgaaactacttgaagaagatattggtctaggcaaagattttttttggtaagacttcaaaagcacaagcaaccaaagcaaaagcagaaaaatgggattatatcaagataaaaatcttgaaaaatattgaagtaaatatacattagtattgactttctgcaagcaaagaaaacaatcaagagtaaaaagaaatgagagaacatattggcaaactatccatctgacaacagattaataaccagaatttataaggaactcaacagcaaaaaaacaaataatccaatttaaaaattggcaaatgatctgaacagacatttttccaaagaacacatacaaattgccaacagggcatgtgaaaaaaatgctccatatcactaatcatcagagaaatgcaaaccaaagcaataatgagaggatatctcatccacttaaaactgctattatcaaaaagacaaaaaacaaatgcttatgaggatgcagagaaaggtgaacactaatacattgttagtgagaatgcaaattagtatagtcactatagaaaacagtataaaggttcctcaaaaaactaaaaataatctagcatataacccagcaattccactgctgaatatatatccaaaagaaaggaaattagtataccaaagagagatctgcactcccatgtttattggagcattattcaccatagcaaagatatggaaacaacataaatgtacatcagcaaaggggtggagaaagaaaatgtgcgatatatacacaacagagtatgactcagctataaaaagaatgaaattctgtcattttcagcaacatggatagaattagatgtcattatgttaagtgaattaagccaggcacagaaagacaaatattgcatgttttcattcatatgtgggagctaaaaaagtggatctcatgcaggtgagagtagaatgacagttaccagaggctgggaagggtaaagaggagaagacataaagagaggttggttaatgaatacaaaaatacagttaaacgtaaggaagaagttctagtatttgacagcacagtggggtgactatagttaataatttattgtatatttcaaaatagctagaaaaaaagatttgaaatctccttaacagaaagaaaagataaatgtttgaggtgttagatatcctaatttttctgatttgatcacaacactttgcaagaatgtataaaaatctcacatacatctgataaatatgtacaattcttacatatcaacataaattttttaaaagtttgcataattatcagcactaatcataaacaaacacacatacaacaaaaaacaaaccaaaaaagtccccccagacctaaactgtgtgtgtgtgtacacacatacacacacacacacacacgagacttagggcacaaatatctgcttattttactcacttccacttctctccatttaaatataaaactttgatgatagcaaataaggtcttctactttcaataacttcccaagtcgagtcactgtcttttgctgtattgatctaaggcattttcatttattctaaatagaatttttttcatcacagggcatccaaaaagacaaaatcaataacctctgaggaatacagaactccaatttttaatggttctattagaatactaaaaattaggctacagaaggacaaaggaggattaatcttgtaatttttaaatgcctactttaaaactaaactaattcatttataattctaggttttattttcaaataaccttaacataaaatatactctcttttaattttctccaagtaaaacatagttttctagcttcagacaactagactttgaagttaagctattgacttgctctcctggattgccagaaaataaagtgctctttaatgtgcagcagaaggcagagggagaaagaggaaaagattattcgggaaactgtgaaagccattgagaagggagcagtctatttccatctacatccatgactccacactgacattgagctttgtagtccctctcaggtaaggatgatagacctttgaacatgtaaatactcaagcattaatgatgataggtacccctgcttattttgttaataaacagatgctccagatattattctaatacttgtttagtggactcactgtgatacgagtgcctcacatacaaaccagataaagtaggagagctggggctcatgtaaaaaagggtctaaggaacatcaatttcttcttgttacataggagatacataaatacatttaaaatatttgatttggtttgatttgtgtattttgtcaaagtaacaacaaaagtcttagtttttctttttaattatgccaataattattttttaaggttttttttggctttttaattttttatttctttaaatacttatcctacaatagtactccaaacctcagcatcacacactatacccatgtaacaaacctgcacatgtacccccgaatctaaaaagttgaaataaaaaaattatcctataaaaagtgttagtttttgtataagacaagattataacccctgtcatagtcaagaaagctttacaatttaggtcattcaaaagcacattaatataaaccttcatataaatgaacaccaattcatcgcattcaaattatgtacacatcctaagttttccaagttatttgtgtatgtttttacctggtaaattaaattattgttatatttacaggtgccattatctattacaccaggctatagcttatatatccagaggaaaatgacaactttaggttcaccaatatttgtggaacataataaaaaatatacgggatattgttggccaatcaattttataattctaacctgaggataacatttaatttaaagtttaaggatataaaacttcacgttttttagcaaaggaaaaagtcatggaaaagataaaagtaaaaagaacaaaagtgaggttggaaatccatcttaagccaaaatgacaatgtcttcataagttaatattaatcctttaattataaattttaaaggtttaagtagtttctatgaccttaactttgaataattatgccatatggagcttttcttaaatttgaaaaagatgctgaattgttgctcaaagccttttcatgatttcaggctggcagaattccagtataatccttcagacaccacttaaaattacagaccaggaacccaagctggtaaatgctatgtcaaaatgctaagagccttttactgagtagagcacattgtagaaaacgtttgatgtgttggtatatttataaatatcaaaacatgaagctgaaaacaactatttatagtggagaatttacaaaggaaaagatgaacagattagacgaaatttaaataaaatgtttgtgtatcataaaattaaatcataaaaggcaaatgccaaagatatttgccacaaagataagggttttatcattctaaatataaaaggagtttattagatgagctgatgagaaaaacattaggaccctaaaggaagaaaaactggaaaaagacatgaacaggcaatttcccgaaaatgaaatataaataaataacaggtaaatccattgtaaatgttcaatctctcacacttaaatatacaaattaaaacaactgtttttcacaaacatgtactacaaattaggtaaaactactaataaatctacagactaagtagatactctactgaagtaaatatacattagtataaactttctgaaatgcaatttgacctgttaattctactaggattttaacctaaaaaaattgaaattgaaaatgtcaacaaaagtttatgtatgatgatgccaatctccacattaaacaattaaaataaaatctaaaagtttggctgggtgcagtggctcatgcctataatcacagcactttaggagtcaaggtgggcggatcacctgaggtcaggagttcaagaccagcctggtcaacatggtgaaaccttgtccctactaaagatacaaaaattagctggatgtggtggcgcatgcctgtagtcccagctactcaggagtatgaggcgggagaatcgcttgaacccgcaagccagaggttgcagtgagccgagatcaggctccatcctgggctacaaaggaagactctatctcaaaaaaaaaaaaacctaaatgttctaaaataaagaaataacacaattaattacatctggctgggcgtggtggctcacgcctgtaatcacagcactttgggaggtcgaggtgggcggatcacgaggtcaggagatcaagaccatcctggtcaacatgatgaaaccccgtctctactaaaatacaaaaaattagccgggcatggtggcgcccatctctagtcccagctactagggaggctgaggaggggaatcgcttgaacctgggaggcagaggttgcagtgagccgagattgtgccactgcacttcagcctggcgacagaacaagactctgtctcaaaaaaaaaaattatgttatatcaaaggccggatgaggtggctcacgcctgtcctcccagcactttgggaggccaaggcgagtggatcacttgaggtcaggagttcaagaccagcctgaccaacatggagaaactgcgtctgtactaaaatataaaattagccaggcatggtggcacaatgcctgtaatcccagatacttgggaggctgaggcaggagaatcacttgaatctgggaggtggaggttgtggtgagtcgagattgtaccattgcactccagtctgggcaacaagagcaaaactccatctcaaaaaaaacaaaacaaaacaaaatttgttatacccataaaacaggatatcatgaaacaatgaaaacaatattttcaaagaatttcaaatgacattggaatattcttagtataatgctttaaaaagcaagagatcaaattaattagtttgatcttgggcagctaagttagtatggctattttacatatacattaaattattactattatatctgagtggtggtaggaacagggaattttacacctttctccactttccctattttctaaaatatcttctatttcaaggaaggttatttttaaaatagctgaataggtttctaaaaccattgtccaatttagataccaaagtttaatcaaacttctgaaaattacacactatcatcacttagtaatgttctttaatttttcaaaagttcatattttatggactttgtttcaattaggtttgaaaagattttaaaaggccacaaaagaagctttcactttgcaaaatgtcaatcatttactctcttggattctttatttgaagcattttgaccttgtggaggtatttcatgtttctcttaactcaaaatcattgaagatatcatttgggtctaaattgctgctgacagaaactcaggtaggatgtggacttaggaattcttttataaccttaacatcgtaagtgctactgaaacaacacagacccatatagaatgtcacactgagattatttattattctggtattattgtcctttcctctttgaacctcaactttatactcaatgatagaaaatgaacttctaaacctctgaattcttgactgggttttaaactgctggcaaatattttaaatttcagatttatttaaatacgataaaaacatccaacttaaaaagatactgtgagaagagttcaagcaactggcagaatgacataacagactcacaaaagaatcagcagcttgttagttttattcaaactcacagtaaaaactcaaattttaaaaaatttgtgtagaaaaattcaaagtatgtctcaataaagattaatgctatgtttttaacttattaagtgatatgaaggaaatcaaaacactaaaagaacatataaatatttgaatacaaagatgtatcatatcctacccaaagtatttataatgatttgagatcaaatgtggataaatcaataacagtttattcacatgaccaggcacagaggctatcttgaatttctcagtagattatcattctttttgttttgttttgttttgttttgttttgagacggagtctcgctctgttgcctaggctgaagcacagtggcgcaatctcggctcactacaagctccgcctcccgggttcacgccattctcttgcctcagcttcccgagtagctgggactacaggcgcccgccaccacacctggctaattttttgtattttttagtagagacggggtttcaccgtgttagccaggatggtctcgatctcctgaccttgtgattcgcccgcctcgattatcattcttttattcactcacttaatatttaatgagtgcttactgtgtgtaaggcaccatgcaagctcctggggcattagaaacaaatatttcctgctttcagggaattcggagtccaggtctttactgcatttgaaaatgctaaactcctttgactatttatgtaaaaatatcaatcattggaaatacaaattactcgatgtgagcacagcatttagatatcatcatatggactctgaggttggtgaattccaccaactggacaaaaaccgaactcatcgcactcaacaccagcctatgtaaaagagagtcttccctttccccagactctccctttttgtcaacaagtccctccattctggttcatctcagtacctctacccatgtcagctaaaagaactgtcctcaaacctcccttctaaattctgggatcccttgtgttctcacttcaatccaggagcattccattcttccagatgcaggatacccatgctccctcctctacctgcagaactccaattctataggaacaaattcccttatatcttcttcctttccaaggcattccactgttcagctggaagcctgtttcgctttttttgaaactcctcacctaagcagactactctgattctttactaagaatacagatgctattagctacaaggtcttttcaagtcttgtcagagagcttctctatatctttaccaatgcttgacttccttcctccattggtgaaggtcatgcctcctgtcactcattcatgtcatacccggagggcacctgccccgagctgggttttctaggcactggtggtacagaagtaaacaagctagacaaggtcctgctaacagagcttatgttctagtgggtgggaggaaacaagcgaacaaataaaaggatgatttcaggtaatgctatgagctatgaagacaatgggacaaaaaaaggtggcataggtaggccagactttggatgaaaaggtcggggaaggatgctctgaggagtgtagaatgatgtcaaggaggttggccattgaaaaaatcatgtggagaagcattctggaagagggtgacagcagctgcaaagacctggaggcaggggagagtgtggcacattctgggaaaagaccaatggacccttgcagccttgtagccgagggctgaggtaggcctgtgctgcgtctgtgctggggatgccattcccacctgcaccacctcacagatcacaagccatcaatgatctctgattcttcacgtcattaagctgttcctctccattagtccctttgtgtacttcaaaatgctcaacccatgttcagccccaaaatatattctctttaactcctgctgctctttggaactacatctttcttttaacatcgtattttcccaaacaacaggatgttccctcacttccacttccagacttatcttttgaaaccctgtttctgggcacacaatcattttcagcgcactgtccaagatcatcaatgactttgtggtttcacatccagtgacctttcttcaaccctcatccttcctgagtttgggtcacattcttgacaatccccctttccaaatagtcttttcctctatttccataaaaatgcattcttctcatgttccttctaccttcgtgacccttcttcaactgtttcctccctggcctctcaaatggagctgtacccctaagttcttccttcacagttgccctctctctccctccctccctgcctctttcccccttgctttaacagtcccactcactctcaaggccactggccaggccttctctgtgggtgattcccacagctgtttgtctccaatcctgcctgctcttgggatatccagaagcattctttcaacagcaagggaaagtgtagtgtcacttcaaactccacatgttcttaactcagttcagcttcctcctcctccgaccagaaacttctacattcctgatcgatttatatttaaccaacctaatcagtgctatctctatgatgattttcaaatgtcctctttgtccccttgctactgccgacactctcactgccttctcacgcacatctgctgtgccctcaaggacctcctgcctggattaatccagtccttgttacctcctgctgctgctaccacatcttgccaacaccaagaggatgatgttcctaagaatcactggaatcttgacacttcatttccccaaaacctttggcaactcctcactgtttacccaatgaagcaaaaatgcttatcacagctttggagactttcgatgatcctgaagctatcttagcttggttgctagctctcccctggatcaacctctatgtcatggaaacggttttgtttgctcttgctttccttattcttttgacttagaatgccatccaacatatctactaattaaaatcctacttatgttacttatgtctcattcaagtaacatctctcccaattaattttcccgatttcctcagcagaaaatgattttccccaaattcacactgtcttgcattatagttatctgtgtagtgtacttgcagtatttttcttgcagtcactattatttttctatttgagggcagtggccccctcccctgttttttatatacccacagtgcctgggataatgcctttctggaatataaaaattcaggtttctaatactaatttttaaattatctttaccctgtaaattagcatcacgtataaacctacatttcacgaagttcatctcctattaaaaagaggcatttggaatgtgaatatataatgcaggaaaattacggcctaaattggatgtgttatatgtctgactttggcatatccaattttcttaaatcaaggtgcacaggtatctgtgctatttaagaacatttacttagaaatactttgaactgctagaagagttgactgaagccaaggtgaagtgagtgtaagagttaacagaaaagataagtggcaacaccactttccctttccatcagtctctcttttatctgctattgtcaaagtctgagactataccatataagaatatttcctggcctggcgcggtggcttacgcctgtaatcccagtactttgggaggtcgagttgggtggattgtccgaagtcaggagtttgagaccatcctggccaacatggtaaaaccccatctctactaaaaatacaaaaattagccagacgtgctggcgggtgcctataatcccagctactcaggaggctgaggcaggagagttgcttgaacccaggtgccggaagttgcagtgagccgagatcatgccactgcactccagcctgggcgacagagtgagactctgtctcaaaaaaaaaaaaaaaaaaaaaaaagaatatttccctaattcctgaactgtatattttagcatcgagacattattattttatcctgctgtgagggaattatcactaacatcccacttagcctgaacatgtcccgagaggcccaacctattggtcttgtagtcttcttcctttcggcaaagaggaattccatctgtccactggcttgggaaaatagccttggtgctgcccgtgactgttccaccctacttcccaccccccagcatattccacgaaccaacagtgaatgctgtcaggtctaccttcagaacatatcccaaatctgatcaggttttactaccttcattgctattggctagacccagctctctattacctttcctctatatttttgcaacagcgttttaactgttctctctacttcctcctttgccatcaattcagtctattctcagcacagcagatgatgacatcctattcaagtgtgagtcaaatcatgtcactcctatgctcaaaatctgccaacttcctctactcatagagagtcaaagcaaagccctctcactggcctactcagacctacgtgacctggacccacaccctgaggtttcttctctggcctcatcactttccctcttcttctcactcatcatttccagacacaccactttccctgctgttctgccaagaagtcaggctcactcctgcctatttacagtcctttttcctatttatttctgggttcatagctatgctatcaagggccaaatctgctgaaatctgactttcaaattaattaaagtacaataaagcaagtaccttaggatctcagtctatgtaaaatcaatgtagtaatggctagtatggtattgcatactctttaaaagctcaacattatttgaagatgaagagggataggtggaaagaaattaaacaaaatttagatgattcttaagttaccctttgcaagtttctcattcccaagataaagactggtcttaagaaactcaagaggcaattttggaaacagcaattcacatttagtacctgactaaaatagttatactttttctgaacgtcaaaagaaagaatatttgagattgcacctttaatataagtccaatcaaaatgtgtaaacattatattgacatttattccaataatatatacttctaaaaagacttttcttatctcgactgaaatatcaacctgggaaaataagtcatcatttatgtgacactgttataaaaagctgtaaaatctagaaatgcttattagacaactgagggaagatctgaaacttagtcccatttaggaaaatttagggatacagccccagtatttctaatcaaaataatattggacaatattataatatcactttattacaacgtgtatttaattactatggaataggatattccatataatcccttccatgaaagccaagggaaaagttaggaaattccctagattattttactggtacttagacataggagcaagatacttaaattcctcgactgaagagtttatacatttaaagagtaatgccatgtctactaccttttggagattaaatataagggtggtggcaatggattttaaacatggatttcaactgcctattaaaaaactagttaaatatcttaccttttccagtgtcatctctgtctcagcagcatgagtctttttcagctctattttcatcttttctgattcagccttcagtttattgacgacaatctcatgttcccttgtagccctttgcttttcctcttcacgaagaagaccaagctctaccagctgctgtttccgctgtgagttcacattgatcaattcttctctcaacttgtgaacctgggcctccatgtcggcaataaccttgtttttaaaaatggaaaaatgggcagaagatatcaatagggaagtcacaaaagaagaaccaatgggcaaaaggccaataaatgaaatatgaacatatggaatagaaagcttagattgcactccatccttccttctttccttccttccctccctctttccctctcccttccttccttccctccctctttccctctcccttccttccttccttccgttccctttccttccctccctccctccttcccttcccctcctcccttcccttcccttcccttccctttccttccctttccttccctccctccctccttcccttcccctcccctcctcccttcccttccttccttccctccctcccttccctctccctccctccctcccttccttccttccctccctttccttccttccctccctccctccctttccttccttccttccttccctccctcattccctccctccctccctcctctacttccttcattccatattcccatgtcattccttcctagctcagaggcaaataccacctggaacattttaccatacttttggatctttaaacaacatattgtttagttttacttgtttctaatttctatgtaaatggaatattacatgtatttttctgaaacttgctgtttcaaatattcaacatcatcatgttcctgaaattcatccagtgttccctattggatttttactttttattgattgatttctgcttttatttttatgtccttcttcctactttcctaaggtttattttgtattctttcttctaacttcttattttggatacttaactcatttattttttatcatttcttcttttctgatttataaatgtaagactacaaatgtctctctggatactgatttagttccatctctttggtttagatatgtggtattttcattatcgtttagttcaaaatacttttttaacttccattataatttttgtctttgacttatgaaccatttagaagtatgtttcttaattcccaagcatatgggacatattagtttcccagggttgccataacaaagtagcacaaactagatggcttaaaagaacagaattttattctctcatagttctggaggctagaagtcttaaaatcaaggtgttggcagagttggttccttctggaaactctgaaggagaagctgttccatgcctgtctcctagcttctggtatttcctgacagtcactgtgccttggtgtgtaaatgcatcattccaatcagtgcctttgtcttcagatggatttgttctctctgggtgtctgtgtctctgtggtgctgtattttataaggacactggtcatactggatttagggcccaccttaatccagcatcacctaattttaacttgattacatctgcaaaaattctatttccggccaggcgcagtgactcatgtctgtaatcccagcactttgggaggccgaggcgggtggatcacaaggtcaggagttcaagaccagcctggccaagatggtgaaaccccgtctctactgaaaatgcaaaaattagctgggcatggtggtgggcacctgtaatcccagctgctcggaaggcggaggcagagaactgcttgaacctgggaggtggaggttgcagtgagctgaaattgcgccactgcactcccgcctgggcaacagagcgagactccatctaaaaaaaaaaaaaaaattctatttccggttctgtgtagacaggaaattttgagagggacaccattaaactcaggaaatggacttcagtggttattgttttgtcattcacttctaattgcactgtggccaaagaatgtagtctatctcccattaattctttgcaaattttgagaatgtttgatggcaagttatgtagccaattttttaaaagcttcatgtatgattgctaagaaatgtctatgctgtattttctacagttttcagtgctatatcctatacatgcctatcatatcaagcttgttacatagttgaaatcttctgtcacttacttactgccactaacacattagccagcaatgcaacatttcccaaaacacaatgataaatgtttcatttcatgcctaatgtatgttcaacaagcacagcctaaaccaacatttccttgactggaaaccagaaaaataaaaaagtgacaggaatccaaatgtcacattatgatgctgggaataagaatacaaagctaaatgatgagaagttgctttggtcaaaatatctacaagaattatttcattttcaatataaatattatattcatccaatttttaattttaacaattttgtgatttctacatgataaataataattgctataattttgagtgtttactttgcaccaggcatcttattttggattgtgttcagtatacattagctcaactattaaccctgtggcctctctacactagactggaaaagacatctagaacagtaacatttgtgttagaggaaagaaaatgctttatagtaataaatctgagccttcgaggctggaggtgataggatgtcccatttttatcctgcctttctaagaaaagcttacttgaactagtcccaaaggaatatgtgagaggactttatataaaaggctgatccttgtaaacctgtagtggaaaaattagttattttttcttcaggaaatctatgcactgttttaacatctatttgtttctctatttcatagattgatatctgtgtatcaataatcagctgtggatcaattgtccgtgaaaacagtcttttaccttttgttctttgttttataatgattcttttgaacccaagagaagagatagtcaatgcaatcagattctgaaatagaggatacatcttctaaaaacagatagactttagcagtgacaacagttatgtgtttgggaggcagaacattctttttttaaaaaaaagctcagggatatcaacatggcagacaaggatgggttgctggctcccttccccaaaatcaatcctggagaaagcacaggaagcatgaatctgagatactaataactataacaataataaacataacaaaagcaaattttgagaagctcctgggtggaataaagacagtcctaagggggtacagcctggggaagaaaataatagaaaaccgctgtaagaaggtgggttgcaggaatgctttaccttctgctcttgtctctctcttttgtagccaggtaaaatcatatctgttccattaccatgttgggagcaagaactcaacatagtgttgacatcagtcagtcaataccaaggaaagcaaagccctccttgggtgaggagttgaagaaaacaggcacagacttctctgaacttcctgggtattcccccttccaaaggcttccctccaaactcccaggactagtgactcagtcattagacactcacttccaggagcttaggtaaattcccgaccagcaggttttcctgatgaagtaactgtgaaagggagtggtacggcaatgaagggctctgtcttggggttcataatcttgtccttctataagctcatccaacaggtcagggactaaaggtgggcttctgctcttccccagtcaggatatctgatagtcccaggggaaaatgggctccctggccaaagtaaataaacctgaggagcaaaactactaccaaaaagagacacctaaataacatatattatctgaagcagtataattggaacagatgaaacaagaattttttaagtgcgtaataggccgggtgtgttggcttatgcctgtaatcacagcactttgagaggccaaggcaggtggatcacttgagcctaggagttcaagaccagccttggcaatatagtgaggctccttctctacagataatacagaaatgagtcaggtgtggtggggtgtgcctgtagtcccagctactcaggaggctgaggaaagaagatcaattgagcccaggaggctgcagtgaaccgtggtcataccctgtactccggcctgtgtgacagaaggagatcttatctccaaaaaaagtccataataaacatacaaatagtaatatatatatacttaatatactgaaaagtgtaatggaagaagttacagacatgaagctgcaattaatgtcatagaagaaggaaaaagtgaaaatgataggaaaaagagcaagttagctaaagccaaagaatagaattgcgcattggaaggatggtaagattgaagaactccctgggaggcagcagagaaagataataatacagaaaatgtaaaagaaaagctaatatttgtggaggacagaggaagtgacaacatctaaataatagagtctgagaaaaatagaattggaaagattttatccaagctcaagctgatttgaaagtctgctttttatcacatactgtatcatctcaaagtattaagaatttctcttaaggaagagtacatatttattgtactttattaatttgttattgtgcgtttctatcccctaattttcactatggttagtacaaagttaacatccaaaagccataagtccataatgtctttttttgaaaattaaaaaatacatacatttttatagatttgggagcataagtacagttttgttacttggatatattgcatagtggtaaaatctgggcttttagtgtaactaccaaccaaatattatacattgtgcccactaggaaaatctttaaaaaatgagcaaaaatgttagttttccaaaagcagtgagaccatcccaaatcgagtttcaatctctgtcaatgtaaatcaaagtattgttatgcacattgtcatcactgtgtagatactgttctatattttcacacacccaattttaatttaattcccatttattagcatatttgtcatatttagtggctccctagtatttcacccttccagtacaggcatatcacagagatattgtgtgtttggttcccgaccacctcaataaagcaaatattgcaatgaagtgaatactgcgatgaagcaaatatctccataaagtgagtcacataaattggttggtttcccagtgcatataaaagttatagactattcaggagtgtctgagggagagaatacagtcatgggttcttggtttctgtttctggttgggccagtaaagccccttcctcatccctcttttctgcttatcactaaagacagaaactttaaaaccatggcttctggctgctaaaagcctaaagcaaaacaaaacagaacaacaacaacaaaataaggtgggttggacaagcttgcagtttattcagtgagcattatgtctaaaaaacaatgtgcattccttcatttaaaatacattattgctaagaagggttaatgatcatctaagccattcttaagtcctaatctttttgctggtggagagtcttgtcttgatactgatggcttgctaaccgaactcctgacctcgtgatccgcccacctcagcctcccaaagtgctaggactacaggtgtaagccaccacacctggtcaatgtttattatttcaatgcattaatggagtaaattatattataggttattttcaaacgttacatcaaccttaggttacattcaattttttccataagataatattactggattcagtttgctaataatttgctaatgatttttgagagactgacctgagggatttttttttttggactctccttggcatatttttaaattgatgttatgctagtctcataaattcagttgctgaatgatgctacctttttcatcctctgaaagaatcagtataagatgagttatttgtttcttaaatatttagtggaactggccagtagggccatctgggcttgatattgtatatctggaaaacattttgactactatttcaatttttctgatggttataggatgattcacattttccggtcttttacagagtcagttttggtaaatttttatagtttaggaatttttcctcttcccctaaatttgacatttgttggcatttataaatttctatgtccttgcattctctacaacttggtgattacatacgttatttttatacattattggacttgatttgctaataattccagatttgtatgtgtgtgttcatgagtgagttggcctggaatttttatttctcttcttgtaccagtcatcttttctatcaatattacaatcttttaaattggtttgagagtatttttctctttctcgcttctctggaaaagtttgtaaaagactacagtgacctgtcccatgggagatttttatagaactcacctgtaaaattatatgaactcagtgttttctttgttgaaagatttttaactgtttttaaaatttgcttaattatattagattatttagtttcctgttttgtcttgcggcattttatgtattcctggaaatttgtccatttcacctgggttctccaattattggcataatgcttttttaatatcttatttttttaatctctgatgatctggaatatatcctttttaaaatttaatgttattaatatctctcttttattgataacattaccatagctttatttttattcccaatattgtttatttgcactttgttctttgatcagtcctaccagaaattgcttcatttttctaacttcttaagctggttgcctacttcattaacaattaaccgtttaaaaataaatggcaggttaagtgtacccatttctctcattttagcttcatccttcaagatttgagaagtactattttcattatcaattatttctaagtattttaatttaaatgttatgaacttatttttgattaggaaatacgttgacattgataagaatttataagccacaaaagtagatacagtaaactatcttccactcacccggactgtcatcaataaccacctcatccccacccaaaatagtaccaatgtaaaaagtgtcaaaagtgtcttaggtctaattccagaagatcaattcttaggtctaattccagagatcaattcaaagtgcttttaattttaccttaattttatcttatggaaaaaactgaatgtaatctaaggttgatgtaacgtctgaaaataacctataatatagtttactccatcaatgcattaaaagaaaaaacattggccaggtgcggtggcttatgcctgtagtcttagcactttgagaggccgaggcgggcagatcacgaagtcaggagttcaaaaccagcctggcaacatggcaaaacccgtctctactgaaaatacaaaaagtagctgggcggggtggcaggtgcctgtaatctcagctacttgggaggctgaggcaagagaatcgtttgaacccaggaggcggaggttgtagtgagctgagatcgcgccattgcactccagcctgggtgacagggtgagactccatctcaaaaaaaaaaaaaaaagaaaagaaaagaaaagaaaaaacattatgattatctgaatacacagaaaaacatctgataaaattaaacaacaaaaattcttagcaaaagagaaatagaaaagatcactttaaccagataaaaggtatttgacaaaagactcatcaaatttcatttattctttattgtgaagttttaaaatatcccttttaaactaggaagaagaaaagaaggtctactatcatcacttgtattcacaagtgtatgacaagaacataaaaaaaaaaaactgggccaggtgcggtggctcatgcctgtaatcccggcactttgggaggccaaggcgggcagatcacaaggacaggagtttgagactagcctggtcaacatagcgaaaccctgtctctactaaaaatacaaaaaaaaaaaaaaaaaaattagctgggtgtggtggcgggcgcctccagctacttggaaggctgaggcaggagaatctctttaacccaggaggcagaggttgcagtgagccaagattgcgccacggcactgcagcccaggagacagtgtgagactccatctcaaaaaaaaaaaaaaaacaaaaacctatctttaatcatagatgccatgacggtatatataaaaaatgaaaatgaatgtacaaattattagaaataagagcttagcgtgatgtctgaataaatgatcaatgttcaaaaagcaactgcagtttttatacatcagcaaaaaaattataaacatttacagctatgacaacaaacaaagaatcttagaaataagcctatcaaaagatgtgcaaaaccctaaggaaaaaaatataaggctttttgaaagacataaaaggaagatctaaataactaagagatatatcagggtgatgaaagtctcttcatcagttctctgcagattaatctagagtgtaagtccaattaaaacttcaagaagagctttcgacaaggtggatctaaaatgtacagggacaaacatagtaccatgacatccccaaaaagaacaggcggtgtgatattccctacaagaaatttgggtctaacataatgttatcataatcaacacagtatagtcttatcatagagaacagaaaaaaattgaccaatgaaacagaattgagaacctagaaacaggctcacactggacagagctggcattacagtttagtggggatgtgacaagccaatgtattctaaaaattacgctgacacaagaagttattcatattgggaaaaataaaagcaagcccctatcttacacaatggacaaaaataagttatttccatttttaggtctatatccaagagaaatataacttatgttaacacaaaaacttgtaacatgaatgttcatagcagcaattttcataacagccccaaaggagaaaccaccaaaatgtccatcaattgatgaacacgcaaatgaaatacagtatatccacacagtggaatattattcagcaataaagagaaatgcagacctaatacatgctacagtaggaatgaaccttgaaaacacgctgagtgaaggaagccagtcacaacatattgtgtgattccaatattttacatgaaatatctgaaacaagcacatctatagagatagattagattagtggattgtctaggtctgggagtgttgagtggaaatgaagagtgaccattaatgggtctgagtttttggagagaggtgacacagttaatggtgaagatggttttgcaaccctgaagatactgaaaaccactgaatggtacagtgtaaataggtgaattgtatggaatggcaattatatctcaataagactgtttctttttaaatcagttcttagtggatgagaaaccaaatgtgagaccaaacttttaaaaatatgggagatggctttatgacttcaaagtaaggaaaggcatgacttaaagggcactaacttgaaaagattgatgaattagattgcaatacagttaagaacatttgttcatcaaaagacacaagaaagagaatgaaaaactaaatcacaaactggaagggaacatctgcaacatatgtaacttacaaaagaatattatccagaatgcctaaagtatatcaacaagtaaaagataaataacccaacagaaaataagtaaaaacaatacatgactaggcacatcataaaaggcaacattttaatggtaaacatgaaaaggtgcccaacttcattagtcatcacaaatgcaaattaaggctattttgatatcattttacaatcaccatatttgcaaaactcaagaagtctgacaataccaaatgctggcaagaatgtgtatcaatgggtactcttacacattattgatttgggtgtaacgtgataaaaccctactgtaagttaacttggcactacctcggaaagttggacacgttcataagctatatctgttgagaatctcttacacgtgaacaccaggcacatgcccaataatgtacacagcagtatttgtaccataactcaacttgtccgtcatagttgtcattgatttatcttgatacaatggaatattatatacagcaaaatgaattaaccagagctgtgcacaacacaatgggtgaatcttaaacataagatactgaatgaaaaatgcaaatcagattacctacaacatgcaaccatttttacaaagttcaaaaacaaacaaaaataatattttgttcagagaatatatatatgtacaataaagccataaaacattattaggtaactatcaacacacaattatgaataatggttaactctggggaagggtggttaggaatatgggaaaggaaggagcacacaggtacaggcagcaattttaatagtgttccaattcttggccgggcatagtggctcacgcctgtaatcctagcactttgggaggccaaggcgagtggatcacgaggtcaggagatcaagaccatcctggctaacacggtgaaaccccatctatactaaaaatacaaaaaattagccgggcgtggtggtgggcacctgtagtcccagctactcaggaggctgaggcaggagaatggtgtgaacccaggaggcggagcttgcagtgagccgagatcgtgccactgactccagcctgggtgacacagtgaaactccacctcaaaaataataataataatatgttccaattctcaacttgagtggtcagttcatgatgttcattttgttgtatgtattagtatttaaatattaattatgacatattctttgtatgtatcagacactagataaaaattttaaaaagatgacacagacgttttaagcccagctgacaagaagaatgcttctaaaagataatttcttaaattttaggacaataattatttttaatacattgtaagagtgctactatttattatggaaatgcacatagcccaacaattttgctttttttgtgaatatttcataggagacacttaattctaattatgtttttgaatattacatggcttcattattccttacttttgtttagtatttaataaagttaattaaaaaataatatattctcttcagaataacatattagtagttctagtaggcattttaattatgtattgttaatattaaggccaccaaatttatgattttaaatcatatgaaatgtatcaaaattattcctccattttcattattctggacacaatacacatacttggatttaagcttataaattcaaaaaaatacattattttaatttacggtcttttagtctcctaatattattttgtaaatgtcacatgcaaaagaattttctttcattttataaacaactcccataagaccttaagcataaaagaatttaaccttaaaagaaaacatggcttttgccttccaaagataaaagttactactagaaataatgacagatggttaatttgtttctaacaaattaaatacaataattaaatactaataagctctgttttgaagcaggagaatggtgtgtcatgagcacgacgggttcaggccataggcatgattaaaaataaacaaaatgggccgggcgcggtggctcacgcctgtaatcccagcactttgggaggccaaggtgggaggatcacaaggtcaggagatcgagaccacggtgaaaccccgtctctactaaaaatacaaaaaaaaaattagccgggtgcagtggcgggtgcctgtagtcccagctactcgggagaccgaggcaggagaatggcgtgaatctgggaggtggagcttgcagtgagcgccactgcattccagcctgggtgacagagcaagactctgtctcaaaaaaaaaaagaaaaaaaaaagaaacaaaatggtagaagacagactattaggaggttttaattcagcacagtctgaggcagaggtgttcctagaaagatgagtgcctccacggccaggcacagtggctcacgcctgtaatcccagcactttgggaggccaaggcaagcagatcatgaggtgaagagatcgagaccaacctggccaacatggtgaaaccccgtctctactaaaaatacaaaaattagcttgacagggggcacgcacctgtagtcccagctactcgggaggctgaggcaggagaatcgcttgaacccgggaggcagaggttgcagtgagccaagattgcgccactacactccagcctgggcgacagagtgagactcctcaaaaaaaaaaaaaaagtgagtgcctcctgggaactctggatttgacacaggtttcagatctttcagatttttgatcctcgggcagtttgccactccatgtgtccacctaactatccattacctcttcgagtcatattttaagatgctgggttgtctatgttaatgtgcctaagtgtccctttcagaagagctgtagccttgtttatacccacgatgtagcaaggaagcagaattttcaagatgtggattagatttcaagagaagcagtccaagctcctgacttcctcatcactggaaatttcttcccacagtgaaagggcaaggaccctaataactggagccctgacgccattcttccaccttcctcgacattcttcagctggtcacaaacacaattagttagtgatacagtatggaagtgactaacctttggtcaggcattatcagaactgcttcattcaggcttctgagagcacgatgtcacagaattcaaatgtacttgtgcttcttatgtaaattatgagtgagcgtagactagaaaggctgaggcgtgcctgctcatggctgttggctaaaggaaagagcactacaacaccaccggcatctttattattacaaggacgtaaatgccgcaggaccaaaaacctcccagatgagtaaagatgtaaaatgaacatctaatttctctactggtcacatcatgtagaaaaggtcagagtgctactatagccactatagccactcctgcagtgggtgggctttttaggggtaagcaagtgtgtgtgtgtgtgtgtgtgtgtgtgtgtgtgtgtgtgtgtgtgtgtgtgtgtgtacatatctatgtaccttttattcacttggtcctttcattttactttatacaggaaagactgtttttttgtgtgttttgtggattttttttgagacagggtctcactctgttgcccaggctggagtgcagtgtcatgatctcggctcactgcagcctcaccttcccaggctcaagcgatcctcccacctcagccttcccagtagctgagatcacaggtgcatgccaccacgactgtctaatttttgtattatttgtagagacagggtcttgccatgttgcccaggatggtctggaactcctgagctcaagtgatctgcccatcttggcctcccaaagtgctgggattacaggtgtgagccactgcgcccagccaagaaggactgttgcagttggtgtgcatggctcgtatataagtgagataactagcttagggtaagtatcatacagtgagaactaagcgtactatattgaggagggcaagttgctagatatatatctataatactgatggcagcaatgggccgtccagatccccaaggcaacctagtgcaccacccacacccttgcacagctgggcaggacccacttccaggcctggagcctctgccacggcctcaacctccctccccataggtctcaggagcccaccagcacgtggctgaaggtgcagctggggactcctgaagccggtcccaagagcatcaggtttgcttgggcagggttggctggggttgccaggccacctgcccctcacctgccactgctgcagggaaaatgcagagagaaggtgtgcagtgtgcagaacccactcctgggaggcccctggagcccgccactctgggagctgttttgatggggtccggccgcgtcacctgacagtggcggagcagcacggttgggcacagaagggtggacagagaggtgccctgaggcggagctgggcccagggcggtgctgcgctctacacagccggtgggagctgggagcaggcaggagcctcaccctcctgggtgcagctgtggtcactcaggtcggggctgtggacctgggcctccctgtgctctaggggtctagaagcaggcaggagccctgccgtcctgggtgcaactgcagccacccagacgcagccacgtacccaggcatctcagcactctcgggggcctgggaaggccccccatttccccaacagggtcagagatgtctgctcccactgcctggcctctccctgctcccggcacccactccaatcctggagcaaggttggggccgagcccaggtgctgttgcagcctggccggttgtgcgcaccctcgaggtatcacggacacagcagccccctgctgcctcagtcccctccagactttgggcaccaacgggcatgggagggaggccaaggcggggctgagggcagcttggcactggcctgcgccccttggcacaaacagcctgggcaacatgaatggcagcaggaggcagacaggcttctggcaggaggtgggtccctggtgaagccctaccttcaagccagggagggactgaagcctgggagctgggctgctggtccccgcagatggcagtggaaacctgtggtgctttttctcggcctgccatagccatccatggaccaatcacaggcacttcctcccctctgaggcccataaaaagccccggacccagccatatcagaagagacaaaggatgaccagctgacaagaggagctacccacctcagggtcccctctctgctgagagctgaacactcattgggacaacctgcctgcagagaggagctaccctctctgctaagagctgaacacctgtctagacaccctggctacggagaggagctacccactctgggtctcctctgagctgttctattgctcaataaagctcctcttcatcttgctcaccctccacttgtctgcatacctcattcttcctggacacaggacaagaacttgggacctgccaaaaaaacaaacccatgccccttgctcaccacattgcagatgacaaggagagaggagagacgagagaaggagaagagctgcagcccttcagggagcccagactcaggagctccccaagccagggctgtaacatcctctttaaagctctgcggttcctgatgtctccaagcttctgggtgccacaccacattcccctgtgtcagccatggcagctgcttatggtatgcccagtccagctgcaactttgcagggagctagcacacctggagctgcccgccccaccgctgctggcatgccggcctgtgcacagcagctggaccccatgctcgctcacatactattcaccactttgagtgggatccaggcaggtaatgcaagctgacacagcctgccaggccaagtgggtgaaacaaacccagtggaccagagcaaaacccaggcaaagacgccactggccacagaggtttctggctggtgaagcaacaccccaaggatcctgtaacaatactctaatcttactttgaagattttgaaaatactccaggaccatacagtaattcaaagtcattattacaaagaccaattatcaatgtaaagtcacataaatgtataaagtttaagagattggggttaatctacagaagccagatgaatatcctgttaagtaattttgaaaaaaaaattcttgtttttagctatttactttaatggagcctatacatttaaattctccttacctctttttctttagattctaaataataaggagtttattatttaataacttagctttatttattactatgtatttcccattttaatgtttttatataaatcaccccaaatttgttcttagttatatgtccctaaaatttcactgagactgctgtcaagttggaaatactgagagataacttttagtgtctgcagcggccaacttatgaagtaaagggggaatgaagtcacccatggctattttttcaaataatgttgaaggggaaaaaaaaccctgatgactaggtttgagaatacatatttctgttatttataacataaaatcgaagtatatatttattatgagtttatattatatgtattaataaattttttaaattaaaatataaagaagagatattctttctgttatatttggttcttgttcgttatgtcaaagttatgaatgaggcaaaacttcagatttttatttgtctaaaacttttcctccaccaaaataaaatatctcattttactttttaataaaagaaatacattgatgaccaggtgcagtggctcacacctataatcccagcacttcccagagggcgaagaagacggatcaattgaggtcaggagttcaagaccagcctggccaacaaggtgaaaccccatctctaccaaaaatacaaaaattaactgggcatggtgctggacacctgtaattccaggtactcgagaggctgaggcaggagaaacgcttgagcccaggagataaaggttgcagcaagctgagatcatgccactgtactccagcctgggcaacaaagtgagactctgtctcaaaattaaaaaaaaaaaaaatacattgaaagaaatatgcattttgagatttatcaaatatatagaattgatgttttgaaattgaatatgcagatttcaaaggacagcatacacattaaaaaacagaatatattaggaaaatactgttgtatcagtaaaaaagaatattttggataggttcaacctgtcaatttatttcatggagactgaatttatataatgcatacaactatatatatgttcattagcatttaaaaactgaaattcatctaaacagtgaaaattaaaagcatattttactatacaattatacaatatgcgttttaacattttttggaaatgattgatttcaaattaagtcacaagttatatagttattttacaggtgaggcaacattttgctgtacgtttctgaattaaagtttacatttcttatagtatttttatagggctcaaatttgaacacgtgttctcataagttattgcatagacaggtagctggtaacagtagaaaagagacacattaagggatgcaggtaaagtcacataaaagtccgggcaagaaaccagcccttcagatgcctaggtcagcacattttctatttttaacctgctgcattctaacctgcaaatagaactttcttcactaatattgtctgtgctttatcaagtggaaaatatttttaagatcccttaaatgaccaagagctatttagaaatacagccagcagattacctttaaaatgattcaaaaattgttctgagagccaataaggcatatttggtattatcggaagtgcatgtgtgtttttcaactcttgttctactattattattagacctagtaattggaaatgaaatcattagcccatcttgtggttcggtgaaaatatttcctctgcaacttgtaaagatgaagaagaggcttaaattcacccaaactccaaagaataggttagctgtggaaggaattctatacacaagactaaagtgtggcacctttgttcacaatgacactagtaaactacaagatgaaggagaggacagaacttaacatataggaaaggcaagataaactttcttttttttttttttttttcagacagagtctcactctgttgcccaggctggagtgcagtggtgtgatctctgctcactgcaagctacgcctcctgggttcaccccattctcctgcctcagcctcccaagtagctgggactacaggcaggcgcccgccaccacattcggctaaatttttttgtatttttagtagagacagggtttcaccgtgttagccaggatggtctcgatctcctgacctcgtgatccacccgcctaggtctcccaaagtgctgggattacaggcgtgagccaccacgccaggccgataaactttaatttggttaaaaactttagaacaattaatacccaggtttggagcacactacaaaggtctaatgtcaagaaaaaaaaattatcttgcctgcaaaagaggacagtactctaggtagagaataagaaagaaagaaagaaagaaagaaagaaagaaagaaagaaagaaagaaagaaagaaagaaagaaagaaaagaaagaaagagaaaatacaaagaaaaaaaagcaatcagtgtatgtgcttatctgaaaggggagaaaacttcaaaaggagaattaaaacatgttatgagttcacatgaactggaaagcattatggctacatttgtttttttgtgagtaatgataccggtaaagattcataactgatgttgaaatttctagttttattttaaaagaactagccacatcatctaattaaaaatagatcttaaagaaagtgagttaaaaactccataacaatctgctcctaggttaagttaaaactaaaaaaggaaaaagaagtttcatagcacattgatctattttggaaaattgcaaatgaaatatctactacacgtaaaatagctatgtagaagcatttattatataaattaaatgattttaaaggtaatagaagtactatatattttttctagactcaaatagaattataaaagtagaaacattccagttgagactgactgaatgacactgaaacaaaaataccttcaaattgcacttttaataaccttatcctgaaaaatgcagaaaatcagtattaaaaagccaatacaggtgcattatccataactcactctggtgcaacatcagggctcacaaacagaaggactacgtgtcaggaagatgttatttgcagcatctagaaacacctaaagttattttcttgacagagtttccaggagtgacaggtaacctatttggccttcgaagaagaataaaattcaggctgaattcttcttcactagaaaactacttttataaagaatgtcattcaagtaattggagagaaggttttcaacaccctctccacttactgtacttcccctttccagggaagcagagttttgacctaggttttttgccagttctgtattagctgctcaacccaaacacgatacacactaaggttgcaaccacccacccacattttatgagtgtcattcagaacacactaattactgtgctaacaatggtaggacattactaaagtattctaaagttttggttgcttaaatataagaaattctacaacactgggacacaaacagttgaatttttaacaatgagatgaaagaaaggagagtgctgccccctgtgaagtggattccagtggctgcctcggtcagaatcatcatggtgatgatgacttcttatcatgacttctaacggcatttccctcccatcatgtgcacgttttggtgcactgtgttcactctgtgcaactactactttaaatacatgcaggccgggcactgtgctgtggctcacgcccagcactttgggaggtcaaggcaggcagatcacgaggtcaggagatcaagaccatcctggctaacatggtgaaaccccatctctactaaaaatacaaaaaattagccaggcatggtggcaggcgcctatagtcccagctactcgggaggctgaggcaggagaatggcatgaatctgggaggcggagattacagtgagccaagatcgcaccactgcactccagcctgggtgacagagcgagactccgtctcaataaataaattaattaattaaattaaataaataaatacatgcagagagaggaaatcactctaatgccattaatgcattggtgttgaatatctccaggacagcaacatagtatcctcgctagacaacttgacctcaaaggacaactttactgaccaggtgggcctccccaagatatcttcagtgtcagatgaccttgcattatgtttatagtgtcagtagagagtggagttaccttgctcttaatccctgcacctgtcaaagcatcttggatgacttttacatcaacgaagcaaccccatgggactatgcaacaatcaatttactataataatttgtacttttgtacatcaccttcttatttgctgctttttttctctattcataaaatgaattcacctgatataaaaataaattgtgtgggcaaagccaaagtaaataactagaaaaaatgcactaactaaattcatggtaatattatttgcctctggttaaaaatataaaatacataattgttaattttaagttatttatcccttttcaacatttaaaattaccttttaattatattaacatttttgggtttcttttagctgaggcttttataagatttaacataaaaaggctattcttaaataaattcaagtgtatattcaaaaggtataaatagctctataataaaaactggccaatagacattagaatcataatacatgattattacatacatacatgagaacaataatataaaaataaaggttttaagttaatttacagagggatttagactaccagttttaagaattcatcttactaaatataatgttaaattcttgtcattatattcttgcatctggtaaaactagacagttatgaaatttaagaaaacttattcatcttagatattcaaccatttagctacagacacaatgatcctaattataacagtgtttaaaataaaccaaggaacaaaaactacctagatcaaaaccatggacaccaatagattttcaagacccacagagaaatgcagtaagcaagtttagagatgaacaactaaaaaagtaaatgtggtttcattagcttaacattttaaaatagctttgtgaattaattttttcactgaaaactaataaacatcaaatgtattttgaacttgacatttttgataacaaaatcttctacccaatttagctcacagctcttctaaaaacattccgcaattaaaaagctttgtccatgtaacttctactagtccatattcaatgggtttccaatgcctgttaaaacgactggtagcctactagttgcatgttgtacttaccgagagtacagaacaaggtcacctgatagtagatgaggtacataatttacgagattgttttcctttttgttaacctaaaaggtccagaaactcctttcatcctctctgtcccatgcaacttcaggcaccagcttgcactctccctcccactcattggatcattccctgggaaggaaggacatacccacactcaagccaaaatgaatcttgcctccaagatgggctggcagctaggaactctggtcatggtcccatcgggctcacctgcctgactaaacctttttgttaccctccatctctgatctggatttcttaccttacacttgtcactaaactgaggttaccaccagtttctcaaattgttttgtgattacattcttgactttcggtaattatgttcttttatctcttgctttaactacctggactcttgaagttcattccttgacctcttgatctgacttcattaacctcaagctgacttacttgagtttctgacccatcatctgactctcctaataatttaatggtccctattaatgcttaccttagctatccagcttctattctcctccctttgccaccccctgcagtactgagattactagatttattctagtaaataaatatccatttatcccccagcacacctaagtaagttctagcaggaaaataactacctgcaaaatgttgaaagagaaatgcatgttgccatggatacagactatatttatgacctaacctttattccatgtagttccaaagcaaagaactagccaataaggaggcaggaacttaactaagaatgtgatccaagaaatcagaaactacatattacttttattagaagaaaattatataaagtgtttttgtttggtttttgttctttgtccagtaaaagatgccttgaatatgggtatatagcatataccaatttcatgtcataaggaaagaatttttcccagtcctgtgtgattacaattgagtgtatataataaagtagatgctgttgattaaaatgctctgcttaatacaaaccacatcagttaaataatactctgcatttcaattctacatttcagaaaaccattatatgtatgcatatgtgtacagatattttatttgcttaaaattttacaggtagcttcacagagttatttgaaatctttataaatatgtaggtattgtcatttccattgaaaatgataaaaatgggtgctcaaaaagatgggattaaggtatctgctttagttcacaaatcttgcaagtaggaatcagagttgacacccataccttctgatttcacttttttgtacttttagacagcactgtcttttagttaacaaaagcttattgctctagatatcatagaaattatttacagaggcttagattccagtgacgagggcactttcttaaatttttaacaaaatctttaacgaccattattaattttgttttactttatcaacaattgccagctggaccaataacactgattcagctaacatgtcaatacaaaagaaatccaaagtaacattagtgggaaaaagcacatgttggtttcatccagatgaaggtacttcccatgtattggcaaattttctctctgaaataatgtcattttattaaagcctgtaattttgcttctctcttaaaattttattgcatcataaaattacatttcaacaggatgttcaagatttattatgaaaattttgactcaatctgtctttgattgattgccactaatattttggttttccatgcagtttctatttcttacagcatgcttcctaatccttctattagatttgatatcttcaacttactacccacattgtagacaactatattacaaggattatctaatgtattctctatattgacaaaactatgcctgtaaattattctttacatcgtaatcaaaaatgtgtcaatctttgttaaagtatctatggtttccctatgctaccttaactgttcatgacagtaattacctaaatgatacttatccttgtcttcttaaccctaaaatgtatatacctttgttccactgacagtagatatatcttactgaccattctcataagaacatagtaaatgatggtatcaaaaaatgttttacagaaggcaagatagctgtattccaaaacatcagatagagacctaaaatgtcttttaaatatctccaaatttctctgaaaaaaaattgatgatgaattatttagtcagaaatttgtccaaaccacagaatataattctttggaacatatcaggaaagttgacacaaatagaaaaagaacagttagaccaatgcattgccaaaagttttctttacaaactttttccactgaatgtttgttttaatttaaaaatacacataatcaaaccaagtagtatagaaatgcccttaataaaaccattacattatgacttatgactacccatctgcaagtcactccccagaggcagacacattttattctttcagttatctgttttcaactctgatgatcgtgaccttaatacctttacgtacttcataaattaatttattcacaatccattgattttctgctataaaaaatatttagtttacttacaccatttactctttttcacttcaaaatacagttgtgtcacaatttttaattctcttattggttatttctataactttcaatagaataactaaactttcatttttccagaaattatgtagcatcttttaattcctcacttcacgcaatgagaatattagtactgcctaaacttcatttggcctattcattctcacaacccctattatctaaattttcacttctgttacctgcactttggttaaagttggaaacatttatgttgtgtctgtaaccatgagtatattttctatgtttcatgtataaactgatttcaaaatgtgaaatttaatacgtagagtctaatcattattcaaaacacaaccagataatatgttacataactacaccttgtttctggcagttttttgtttctcctgaggcttctaattttcttctttctcccttgcattttctgcttttactgcctcctaacattgttgagaattctcatgaatagtatctagagtcttcttcctcacactccacttctgttccaatctggactggatgttctttccagactcactgcacagctatactgtgcaacttttctcttctcttctcctggacaagatccactgttcaacgaatcttctgtatttctctttcatatttattcctccattttatttaagaacatccatacaacctccaaagaaatgcagaaaataaactttccaaatccttgcatgcttgtaacgtcttatccaacctgagatttctatacaatattgaatattggcttatgtatagaagtctgacttgtaatttttccttttcatagttctaataaaggcatttttctcttttaccatttattatttgaaatctgatgccaatctatcttgttcctacatagaggacctgattttcctctgggagtttttgggatctctcttttattccttctgttctgaaatgtagcaatgatatgtggagacatggaccttttcttttgtgatgctggtacttattaaccttttcaacctatagacctatacccttcggccctgtaacttcattgacttcactatcattattatgtagctaattcctccactacattttctgtttcttgaacatcttggattaatcatcaatgtcttagatttttgaaatatatttttacactctatttttgtctctgcttgttgttctgttttgtgaaaaatattcttgatatcaattttggctggcctttaaaaaaatttaatttctaagagccccttcttattttgattgttacattttcagagcagcctgttcttcttttatgaatattatatcattttcgatatttcagttttgctttccttaaatcttcttttttgtatcctgaggttcttgttttttctctgtgatcatctgtttgtttagtctttctcatgcctctcaggccagccttaaacttcagataatctgcgattatctgttcctattcaaggcagtaaaatgcagatgagaagctctgcacgtgtgtgtggctagagtcggcttggtaaggggtttactgcctgattgcggcccagccctctgtctgattgcagtccagctgcaattcaaatctaatccagttttcccaccttgggctttctccaaacccagggaagcctgctaagcccaagtgcaggtgtgaccaggaagtacaggaagaggcaggaagtgcagggccatgcaggaagaacaagtgtggccaggaaatgcaggggcagatgccctttgggagcaccctcaaacacaaagagctggaagtccagggttaagtgctgtagactccctttctttggtgggacaactctgtgtacattctaaaagattacccaggggtcctcagtggaatggagtctcccttactcttaaagtagtagcttgctcaaggaggcaccctttatttgttgttctcccttttctgtctcactctcctcattccctcacttcagactcctacaatttgccataaatggtctcagggactctatttctagaataacccaaaactaagacaataccatgcaaactgaagctcttaataaggttctttgtaacactatgtaacactatgtaaaaaccctatgtaagaacactatgtaaaaaaacactatgtaaaactgcaaaggaaaatggtaggctgatttctatgaatatatctagttatccttcattccagtcgatttctatggccattagtttaaaaattagtaggcatgaaattatgtgatgtgatatgagatgtacacatatacacaatggaatattattcacccttaaatttcttcatatttgtgacaaaaatggatgaacctggaggatattacgccaagtgaaaaaagccagacacagacagacaaatactatatgatgccacttatatgtggactctaaaatagtaaaactgatagaaacagagaacagaataggcaactcctcattccagggagcattgggaagtgttggtcaaatgatactgtttcaattacacaagatgaataagttctggagatctaatatataccaatgtgactataattaacaatactgttttgtatacttgaaatttgttatgagggtagatcttacctgttctcattgcaaaaaaagaaggaaggaaggaagggagggagggaagaagggaaactgtgagatgtcggatgtgtcaattagcttgattgtggtgattattccacaatgtatatgtatgctaaaacatcaaattatgcatcttaaacatataaagctatttgtcaattatacccccaatgaagctgaaaaaatgatgaagcaaatatacacattttttaaaagtctgcttttagtgacctttaaccaatttagtgaactgctaagcgaccttgagtaaaacaaaatgatatatgtacaaaacaaagccaaccataaagacaaaaaatgggacaggcgtgtttgggggacactcatcagttaagaacagctttccaccacttttggaggagagaaaataggacaatatcgaggtgttgaggaatggaacatgctgtgaaagccggaactagtggggaggcttcagcagatctaggagcccatttagctatcacacattctcaagaggctctgggctctggtactataaagatggagaaaacagtgagaagtgaaaataaggacgagcccccaaaagcctgcatacagaggggttggacccaccccaacctacagattgtaggcagtccaggtgaaaaacagaaggctcttccctaaaaaaaaaaaaaatggaatgaacaatctgggaaaacccacagcttctagtatggcttctacaaccccagaataaagcctctcttcattccagcccttaaggggcctgaattctaacacatctattcccccaaaaccagaactcactctaaattcccactcagggagagatatattgggaggagggacagaaaagaaactccatttacacaacaaatcactatcccatctgcgtaaactgaataatgcatccctttcccaaaatgttaccttatatgtgaaaagggactcagcaaatatgattaaatcaatgattttgagatgggaaattcccctgaattatgttgtaggcccaaggtaatcgtaatcatgagggtccatatcacagcgaggccaggaatgacagggtcagaaagaaggcattgtgacaatgacagcaccaagaggacaggtgacatgacatagggctgcaagcaggaatgctgtgggcctgtagaggctggaaagtcaaggaaacatacttttttcccctggaacctccagaaggagccaaggcttccaacaacttcattttagttttgtaagactaatttcagatttctcaccttcagacctgtaaattaacaaatttctgttctttccaggtacaaagcttgtggtaatttgttacaatagcaataggaaactaataccatttccctttcgtaaatgtgactcaaaagcaagaatcatcgagcagataagaaaagccaagacaaataactatgaaagataaacagaaaaaccaaccctgaaggaaagagatatttcagagaatagaacttaaaaagcagtctaattcataaacttggaaagaggaaaatttattatatttattaaatgaaaacaagatgctctgaaaaagaaataggaaaagtacaaacagatcttttcaagtttaaaaatatgattccagcacataagggaaagcaaatctaaaaaaacattgagtgaaaagacaaaatgaaaaaaaaaatttgcaaaaaaaaaaaaaaagtcatgcaggcaaatccaggaggttcaatatacaactgacagaagcccagaaaagacaataaacaacaacaaagctaggatagaaaaattatcaaagaaatcatccaggggaattttccagacatggaaaggaacctgtaccaagtcacatcaataatgaaactttagaagcccacatattttgttagatttatttctgggaaccttgtggttttgtgctattgtaaacggtattttttaaaaaatatgttgtatattgttactcatgtataaaaatacagttgattttgtatacagaattgattttatatctagttattttgcctaattgttaatagatttaggaactgtcaaactattatttagatgacctataataacaatagttctgtttcttgatttccaatcttaccttattttttctcatcttactatggagacagggacttctttaaaatatgagataaagtcatgataatggatatcatcacgatttctgttactatgagcaaatactattttcaagaacatatgtattaaaaacaggttaaaaaccaacaaacatcaaatttaaaaaatggggggggctatcttatggaggcagacaatgtgctgaaggcagtttccattaattcaactgactgtgcaagctatgacttctttcttgtaaaatgtgatgactatttactatcaaagacctttctaagttaggctcatggtctcttctaaagaaggtagcattgtctgctttctgagttccttgtctgctaagttccttgatttagagttagaacataactgacagaggcaatgaaccaccttgtaattgtgaggtgtgaagacgtgctctgaggctggggctagctcacacctctgaccagagtatggacacatgtggccagtgctcaacatcagttaaacgtctgaatgttttttattcaagcaataaaatcttttgattgttcaacctcgggtctttacctaataaaggagcaacacttattaattccaaaatgaactcaatttcaaatgagaaagcctataattatgataaaaacacaaaaatgggccaggtgtggtggctcatacctgtaatcccagcactttgggaggtcaaggagggcagatcacaaggtcaggagatccagaccatcctggctgacgcagtgaaaccctgtctctactaaaatacaaaaaattagccaggcatgctggcatgcgcttgtagtcccagctactcgggaggctgaggcaggagaatcacacttgaacctgggaggcggagtttgcagtgagccgagatagcgccactgcactccagcctgggcgacagagagagactctgtctcaaacaaataaacaaacacccaaacaaacccccacaaaaatggaatggaaagtcaaacgctctctggaacatggaggaatgctactttttttttatagctgatgaatttttcctttttcatcatttttatgagaacaggcacagccaagttttacacattaacttcagaggcaaagcagaaaacaggtgtgtgtgtgtgtgtgtgtatgcacatacacatacattcatgttgcatgttttccccttggccatcagacatagcttcaaacaaccatcttattattttatcccttaaaagttaatttattgccttggaaagagctaaagaggtttctgaagatgatctcagacaatcttttgtcaattaactatcctcaattataacatcatacccactggacatggataaaaagaacaagtgatggctctgtggtacagcagtgccccatgacacaaataccacattcatcctcataatgacaacatgccaatggtataagagaaatatctctaaatactgaatttagtttatgtaccagagaagtacctaaaaagtcaaaccacatcaatctcaagaatcactacaaggagaccacaaaattaaaagcattctctattctgaactgcattttgaggatttcaacataaactttggaggagaaattaaaactgtgtaggaatactactgttccctcactgcggaatcagtagcacaattcactccttggttgattgtggtagcttttagcaaagaaggaaatatgggacttttgactgtgttcctgcttttcatggacatggtagcctccacagggagaaattatatggaagtaaaataattttgtacttactgaaaaacattaaaggagtaataaagggggaaaattatactcgttttgactgaaactaaagtccacaagagcagtgcccacagggcatgcactactgaaaaacagaacctcccttctgcctgctgcctgctcccagaatggcctacatctccttcttcacggttgatctcaactgattacgtctctaatactgtactgagcacataattttatatgtatgcttctttgccttttgccccttaggattaagtgggtcttattcattttggcatcttcaacagctagcaatgtgcctaaaactaagaaggcccgtagtacatgttgggcaaatattctttcattttaatcatattgccagaatggttctcggaaatcattattatttggagatttaatgaccatctctgcatattttagaaatctgagggttaaaaaatatgatatggaaacaagcaaagcccagatctaaagcaatctctgcagcatagttcaatgtattgatttgtgttccctcgttcactgattaagcatcggcacttgggccaggtgctctagtaggttattgggattcaaaacagacaacatatagtccctcctctggaagacacaaacatgcacaggataatgacattacagtaagtataggcttatgttatacatatgtctttgtcactgtatgttaaaaattttgtgagagctcaaagagatgagaatgataaatacactggcaaagccaccatccactgaagaggaaacaaacaaaaccaaaacactaaaacaagttggtggcttctctgagagcacagcaagccgtgagcctccttccctgtgaccctactcaactcttagtttgactcctcaaggggcccttccttggcttttctgtggctctaattcatcagtgaatctgccttcattaatacagccacatgcatatgtttgctgaggtcacagtctgtactaggaaccttttaggcatagggtatacagaagtgaggaaaattagtaaggtctcttttgtttcagtctctgggtggaacaaacaaatagaataataaatctgcaatttaaatggaaaaaagtgttatgaagttcacaaacaaggtgctctgatagaacacagcaaaagaagatgctgggaaggtaacaattaggtcagatcatacaaggtattgcagctcatgctaagaagtttacatatatatatatatatatgaagtgtatatatatatacacacacacacttcatctatatacttcgtatatatatgatgtatatgtgtgtgtatacacacacatacattttttccccaagacagagtcttgctctgtcacccaggctggagtgcaatggcataatcttggctcactgtaacctccgcctcctgggttcaagtgattctcctgccccagcctcccaagtagctgggattacaggcatctgccaccatgcccagctaatgttttgtactttttttagtagagacagggcttcaccatgttgcccaggctggtctctaacttctgacctcatgatctgcctgccttccttggcctcccaaagtgttgggattacaggcgtgagccaccgtgcccagccagaagtttatattttactctaagtgcaagctatgaaaggattttaagcaggggagttttctaacccaatgtacattttgaaaaagatcatcatgtctgttgagaaaaataagagataaggcaagattatcagttataagattacatagaggcctggactagaggagtgggtggcagtgaataaagtgaatggattggagatcaatttgggggactgaatctatagaatttactgacaggttaagagaaaggaaaaaaatcaagaattatttccaagttctgccttgagcactgaatgtacggtacatagggaggttgggagggagaggcttcagttctggacctatgaagtttgaggtgtttgtgaacaagctaatagaagatgtcaagagcacagaacacagatgagagacgggaacttgaaggttattagcatatagttgttaaggccactgaaatgcaggtaatcacttaacagaaacatgaatacagaaaaaaaagtgggggtagactccagtgttcaacgtgaaacagaggagctagtggagaaaacagaaactaacgtggagaagtagaagtggaagaagcaggaggaaaactgggaagatacagataatttggtaagacagcatgaaagcgttatttgcagtgatgaatatctagctacctggtgaaaagcaatgaagactagctagtcagggtaataaaaaagagggaactaaaacagaattacagagtgaacagaattatactgtgagaaatccaacttcttccatgtaattcagtaaactcttacatatctacagaaaatatgtaaggagtaggtaaaatatatttcctgatacatcctatacaaaagtgtcttatttcaggttttcttctaaagagggaaagacaagtctatgaaacattctagaatatgaggtaggctatagacagtcatctataggacttttcccaacagttaatgttttgcaaatttaaaactatacatattcggaatttattccaactatagtttggatattagtttgtagtttcttttttttttttctttttttttttttttgagacggagttttgctcttgttgtccaggctggagtgcaagggcgccatctcagctcaccacaacctccgcctcctgggttcaagcaattctcctgcctcagcctcctgagtagctgggattacaggcatgtgccaccaccctggctaattttgtatttttagtagagacagggtttctccatgttggtcaggctggtcttgaactcctgacctcaggtgatccaccctcctcggcctcccaaagtgctgggattacaggtgtgagccatcgcgcccggcctagtttgtagtttcaaataaaaatcctatttgaagagcttgaaaagaatgttgtataattattaagtctgcacaattaaatggtacctaacctcccaagtaaatggaagaacgatttttatattctgagaaatagcagatttctaatataaaagcaggtgcagattatcttgagaaaattttctaatggattgagattatttatactgatttatatttagaacattaaaaattatcactttttactttaaagtgaacttgggtttatcttctaggtttgtaatgtccctaaactactcattcagttacttaactatttggctgaagataatatttatcattcaacagcaacagggcaaagacgatgttgaaatctgctttcataaatgacttttttccagatcaatagcagagtaaggggaactattttaatgcaaaacaagtcattgttttaaagttatgttgttttcctttttaaaaaaaaaacggtttgaattaactgcctatgcttcattaccctgcaatgtacttcaacacatttacactgcaagaagaatatgtaataaaagagaagctgcatcttcaaatctttcttgtcaaatttgaagagacaccaatcaaccaaacacctcactaatagtcatgagactgctgttttaattagctggtgatatttctgactaagactctcagatgatgaaactgtttttccttgtattgaaccagcttggcccagactagcctgtcctgcagtgacaggtatattgaatacaaatcagacagcacagctttaaatctgtgttgcagctctcatttccaattcgagaactgtactataatcataagcttctggtggatgaaaggaaatcagctctctgaatattagctaatgccacatttgcaagtcctgaagagatctgtgctgttaaaaaaaatagatcatttcacgtgaacctatatatatgaattgctttgtactgctcaactgatagaagcaatgcctgtgctgggattaaacccttttcatcataaaacctcatctggttcggagtccaagtccatcaaaccttttccctttaaagtcccgcctttggttccacatcaatttattcaaaccgcagctgggtggctgaaaacgaaaggacagcatcatttaaaccaaccatgttcctaacttgaaagaggggctataattaaaaaaatgggcataaaagaatggaaatgggataatattttttaatggtagttcaaaggctgacagatgtcagagcctttgaagatgtcagtacactgagtaagaagttgccataaaagagcttgccagagaggtgaagcagctttttaatggctaaaaaaacccttgcagacacatccttgtgtttttaatttgtcagagtttctgcagtattttctgattaatgacacatgattataacggcatagcaggcatatttttatacttggttaaatgaatagtttatttcacattcttttagagctagataagaatagggacactttcctaggaagtccaaaactattctgattgattgacatatttatgctaattttgtgggactggcccaattcggaattactatatgttgccagcttttgttctttaatagtctgtttgctaataacattacaattcacatgtggtagttaaaatgcaattcactacagtttcattcttttcatgtacatggaacaatatgtgcctgaataattaatttgtgcaccaagtcatgtcaaaccaaattaatgttttaagacattcctgagctcaatctacacaaccgcgggctgccatagggttcagaagagaaagggttgcttaggggaaaaaaatgcagctataactataatataacattaatgcttactcaaaaaaacgagctggaatactatgtgcaaaatgctgggggacactcttctaagatttgggggagggacttagagtatttccaaactatatgcccttctaaatagttctaacatgtcaatttgatttgttctgtgaaattgccctcacaatattcatgaatgttaaccacaagtctctagtgagtagtagcaagaaaaaaaaaacaggtttccccaccaatggatatgcctgtaacttataaccatgatgaggtgcaggggagacagagttcatggctttgaagtgagacacattcgggttcacatcctagcccttgcacttcagagctgcatagcttgggtctgtcttcccacctgtaaaaactgagacaatacataagtgcctcctcccagaaagcatgtgaaggtgtctagcacgtaatattgttcctttctcaaactacatgatatacagaaaattttaaattaggccattttctgattgaaaatgtttatatatcacaaaatcacattttaatgagaataaccattcttttaaaagtggatgttgacatttcccaccgcttcaggaccaatagattttaagtactgtctccatccttatgttgtaatcttatatgaccatgactggtcaaacctgcaagcatacacctgtttgtgtctgacatctaaccttcagcccagtgctacaagcacacccatggaagcagctcagcaaatgcggtgctagggctcaggcagggatgcaggagagagataatattctcacgcaagatcaggcaagagacctaggaagcagagaggtggagtaggcagtgcccccaacccagagagagcagatcttgcagcaggcaggagccctgcagcctgatcctgaagaagctgacctgcagtcctcttgccacccctcaggctttctctggaaacaggagcatcttggggtttaccttcctcatggagggggtgtttcctctttcaggtctctatgtgactatagttttgtatcactaacactggggacaatttcaaagcaggtaaagtttgccttaagcgtctttctacccccttgtttgcacttccctgttttttttcttgccttgctccaacccacctccagatgtccacgtcttccaaaaactcccccagggcatcccaccaggaggttatcttccggcaatatcactcttccttctccctttacagtctttccatacatcagaactcccatttcttgagtgtaatggatttcagcttgatgagagcaatttaattagaaataatttcacaatatggtacgtacaatagctattttcctgcccaattcaatgttgttcagatcttccctttgctatgaagactcccccgtttccttcaggcaatcagtcttctggcttggggtacagggcagatagcctttatcctacttatcatgctacatccacttgctaaattttctgctaagaatccttgcaggggaggcctttgtcttgtttttgtatacctcctcttagcgcagtgactgctacacaaaggtgttcaacaaatgaaggaacaaagagatcaatgaaagaagattcaatttcatctttaagatgatcttttttttttaccatatatcattattcatttaagttttaatactgttcaggaattatctattcaggtatccattttactgtatatatttatccattttgaattttggaatgcattcatgagttacttattcaaggcaaatgcattaaattaaaatcaagaaaagggcaagcaagagacagaatgttactcagcccaaacaaattctacttagagatacttcaagcaatgtaatggacagattccgggcacagtaaagtatgtggggtaggagcattcttaaaaccgagtgactcagtctaggaatctgggcattttagaggagcttccatgcagcttgtggttggaagctccttatctcccattagctgatccaagatatgttctcccgctgatcagctcctcaaactcttggctcttagataggcccaggcaaaacctattccttttttcctgtcagaattgagtttgtgcttcattgggtgatcctgccagttaatccctgcttccctaggtgaggcgtgaaggctttcttagtacctaattggcaaagttctctgtggacatgaaaccttactggtctcaggagcaaccataggactggagatgctggactggttgggtgttgtattgatcctccccatatcactaaacaagcccggtttactgctgcctgaaaatcatgcctgtgtctgtcagtaatggcccgagttgcttccttcaactggatctcgttttccacctctaaaatggactccctgatctcacagcccacaaccacttcagaattaggtgagaaacagccagtgttcatggactgctgttcatttggtgtagtagtccatttatgtataaccacaattcacaactcgagaaaataaactaatattgacagggttattcagaagcatttgcccattccaaattctcacaataatccacgagttaggtattattgttacttttttcctggctcatgaaataccactttctcatggttccctgcctctctctcttgacctaccttcccactttcttagtcttcttgtccagctctatttccttcaccttctctttaagcagtgtgtctcttcttctaattctctttccctccataggagatctcatcttcactgttggtatccattaccctccatgctcatgattctttaatcttattttcaatagagatggagagctgtcctttgaagtcagtcctatacttctgcttgcttaagtagcatcaacacataaacgtcctacagcatgtcaaaccataactcaaggtctgctctctctccctcactgccacatcaactttccccattgtcactgccttggctaaggccctcatcatctctcgcgagggtgactctaactagtcacccaggctccagtctcactgcctgctaattcttcatcttctgcttaaaattctgcagtgactttcgattgttgacagttatggtctctaaacttttttgagacactcctatcataaaatatacagtgcgcgtatatatataaatttgtaacactattaatatgttaaatacattatacaaatttgcacaaagtaagtatttttaaagacaaaattcaaacacacattaacagaagttctgggttttttctttctataccctagtgaaccccacttgggagaacactgctctaaataattactaagtgggataataagtgtaacaagtggaatattaaagtggaggaatggtagaggcattgcagatggcagcacagacagtataaaccacaaactggagatcactggccaagcggacccagtccgaacttctcaacatggtacgtgttcttcatatattaatcatgctactctttctgtttagaatgctttttccattctaatttgcagagaacatttcagtcattttttaaaactcaaagcatctgatgtctactctaatggaacctcttctgatgacctcctcagacctgatgcccccacatcccataacttccatctctacttttcttgggatcaaagcttcattatgactttgttgtactttgctgtaactctggcaggcctgaagggtaagtacgctagagtaggccgcagaatataaccttctatttccatactccctctgtcattctcagaaagatgctggcattgtcaccagttacatacctggtggacaggcaggtgtacagtcaatgtttctagacagtagaaatggaccaaggggatattaatctccttccataccaaagaatggtaaagaacattccttaaagggcctgattaaatcatcacaacaatccggtgatatcatcagcaaagggtgccttcataacaatgtgcgagcgaggggagcttgtccttctgaccagggttattgttactgtgtctcctataccacgcagcctttgatgtgtggtaagatgcgtcctctgtctacgttaaaggaagacattctttactcatatctgttggtatgaattatagtattctccatttatgacagatgcacaatgcctgtttccccatagactgtaagcttgagggagaaaccattccttttttatatacgtaggtccggcataggggcctggctcatagtaggagctcaatgaatgccactaaatgaatgaatggatatcacaggtgtggaaaatgatgattgggggtattaaggtaattagctaatatgaactcaggtttatagagccagtaaatgatagagactggccatgaaccagcatctctatcttaatattcaataagaaattggtaattgcatctgggcccatgctttaattattatctatatgctcagttcgcatctctggaatctcaacctgcatatccaactcgctgtctgacacacttccctctggatgtttaacatgcagctcacacttagcttggcaacaaaagacctcttgcttttgcttctgttccccggcaatcttcctcgtatttgacaccaccatctatacagctgctcaaaccaaaactctaggagttactcgtacttcttcttcccctcattccccacacccaacccatctgcaagtcctgctgcctcacatacgcatgccatattggcatctaggactgttcacaaacagagcgatctgtaaaaaacatgaatcaaatcatgtcaccttactgcttacagcctctgtcttcccatcacatttaaaatgcaattcaaactcttcaccagggcttaaaaagccctgtgtctgctactccctgccccctttctcatacctgctatgctcatgccagacaggtctcctttttcatttcaagaacacacaaaacttattttcctacagggtctctgcaccaattgttgcctcagtctggctggcttcttatcaatcagatcttaaatgagatatcttttctttggagaggcgttctctgatggccagctaacacaattgtcactgtatcatatctctcaattttaattctccacctacaagttattgctatgtgatactctccttgttaatttggtttttgtcttatgatctgtcttccccaatgcaactgtaatttcctttagagcagagtactggtctatcttgcactgggtacaggaatacccttacggccatataggccatgccctgtacaactctggggcaacattcacataaatcaggatgtgaaaggcacctcctaaaggtgtgcatgcccagccctagggcccggcacagggtaagcactccaaaattcttaatgaaatgaagttgaaaaaagttaatgtctgcctcatttttggccagcaaacttacatggaaataaatttgatttacatattatctgaagggtcataattataaaatgtccaagtcacagagttccatgtttttctatattaatttgaaacaatgagatctcaaaaagcaatcaaaacagttaacaataattatgatttttcttgagatttactctactactcttgttcctgaattgaataatgtttttacgaaacaccaacattatggcagtagatgatgattttttttttttattgtgtgccactagaaatggttagagaggtgacatcacaggagcgcatttccaaattttgccccaagtctgaaacatctatgtacagtccgggctttaacaggggagcctggaacacactgcagctcttgaactcatggcatttgtctaacgacagctttggcagtaattggtggataagcagtaattggtggataattgaagagcaaaagttttcaaccctcacactccacttctcttgttgtgcctgtcaatgtcactataactggagctatcattttagccaacaagtgaggataacatttacatttcaaaaaattagcttttcaggaaacatttggtgaacacatgcattttgtacattaaatgacatctttgaaaataacgaaataagtaaggtcccacttgaccctagggatctggggtttgttttcgtaataaatactgacttaaggagcaaacttaagatgaatgaatcaccactttaattttaacctttttaaagacctgcgactttcaggtctttccactggaaaatccccttgttttaagatggtgggcctggctgaactactggatctctgttcactgaaggctcttctgtatcacagagccacagttatccagtgaaacgacacacacactcctcgagactagtgcagcattacaactgtccctacaaacaagggaagagacctagatccaggtcacatcattcagcacacttcaatctctgaggacaccattaactcatattcaaatgtgactaatactttcagtattacttgactaatacttgacttcatacctaagcaaaacaaataaaaataaaccagaaaaataacacattttcaaaccctggaagtctaattgtgtattgtttctttgtgatttcttatgatttttcccaacctcccaataaacaaatatccaaaagcactcaagagatcaagacgtaatttaaaataattattaaaacaagtgaaaaagtataattttccttgaattttaatatttgtttcaactaaaaaacattatctcaagttgcacactaacctactgattcaatacttgggggctcaattcagcccatttttattatctaaaactttctacttaatgacaatatttataaaatattttctgtacacaaatattacaatagttcgaaaacagaccattattttcatacagtgctgtgttctcttctccaaataggcatttaaggtctccctgacaccaatttgtgacatttttgtcatgaaaaaagctcaggtgttaaatatctttcatatcatgcaagtaggcatgattccaattagtcctgaatgggagacaaaatgacagtttaataagcttcaatttgccagctctttgaacatttgatgatatcaccattttgcccatcatttcttgcactttggcttcaacctctctgtcacaaaaaattaccacaaatatacaaatgaagacatcagggatgtctcttacagaaccgattgagtcagaaatccaaaaatgacttttccaagacattaaggaagaagagttattcatccaatactttctcagagataatttctgccaatattcctagtaatttcttcgaggcctaggtgaaaaggagaaggaagagtaatatgctaaaaataactcaaggcatatttccttatgtcaatggaaatgacattctgcatgcagaataatgctttttctctggagtatttattttagaaaagaattcatcttaaaagtctttactttgagcaaaatagctctaggatgaagctaacactgcatcaacataaattgtttttgaggagtctagaagaaacacattttctaattatacccttgtatcggtatgaaaaaatctccaggtttgaacttcataatccttgacctcatttctaagtggcttttattggattctgtcatgcaataggatcctcattcaggttcctttaggaaaaaaatactaacaaacattgaactctgagagttaaaatttcattctataaaatgaatggatcatatgtaatattccaaattagtatgtgaatataacaaatatccacagatcataaaccattcacaaaaaaaccataccttaccactactaaatgcaaattcctacgctgtttttatcaagactggtaggcctcattgacctaaaaacttggtggattcttactctgggcactccttcttatttcagcaataatgtgaaaccaaaagtgaacccatttcaaaatgtactcactactcactgttctattctacaaattctgaaacttgttggaagaaactatattccgaagaaaatattaaggattgcatatctctttagagtttaatttacctcaaaagaaagacatagtcatggcttgtggtcttggagaaagagtgaaactaccggctaatacttgatttggatatatgtagtttgaattatgactatcagtattttaaatctattaaggtagtgacaatccaaaattagcaatataatggatttatgcagaataaataaaattcagagacaatgtgctcatacactagcaggcatatggggtagaggactttgctatgagttgggcaatttatttatgctttctgaatctttcttcattggtaaaatgaaaatacatatagtcatcttctgacccaggtaaaaagatcaaaacagagtttctagataggaaatgtcatcctcataaggtattaaagggttgcataagagaatgcaatgcaaaggacccagcagagagcttggcacatggaaagcacaccataaatacttgttgttgttgttgttgttgctgttgctactgctgctgttaaacacatacaaacataaaaactcagtgttgttggaggagctactacatactcaaactggatatcaagcagcattattcaagcattattatgactttgaagcaacattaaatatggcaaatcgctgaaagaaatgcaaactgctatgagaagctcagcaggggagcagagtaccagtgtctctctctcccacaccaggcaaagattcctatataatcctgttccttttttgccatgtccaagtctctccaaaaatctaaaatctttcttggaggaaactatgatagaaagagcactaaattcagattaagaagccctggtttgctagttctgtgaccttaggcaagagattgtccttgaatcataggtttcttatctgtaaatggaatacagttggatgtggtcatctctttagattactttatctgactatcctactgctagatacttacacacctgatataactaaaggcttcatgttggcagaacatatggtatacaatgacttgtggtcccttgcaaccctcccagttctcaccactgcagtgatcatattttactccctatttaaaatctcttccatatttaattacctcttcttcaagaacaattttaatatttctaaagaaatccattaaatataatgagaacaaaagatagatttttaaaacaatcattattagttgacacaaagttactaatgcaaatggaatactttatggtattatttagaaggtttgtctttaaaagaaatgctccctatctaaaagtggaccaaataccacagaatgtagtttccatggtaactgccacattttaaaaatatgcacaggactaaagatacactgtatcttctacaaatggatcattcttagagcaatcatttttcttgcctcatcttgtattttttgctttttaaacaatataattttctccatgatgagggcaaagttaaattgtttataatagtttaatcacaggtatatatacactagttttatgccttcaggatgaaaacaattacagaactttagaattataatagaaaaagaaagctggtgacctacacaaaatgtaagctttacttaaagcagcattttcctatattttctgctaactaaatacttaagaaatagtattattttacttattaatttgtatagtaatatataaataatgcaaatttattattaaattcacatgtaatactaaatagacacaacattattgcatactaatgaaacatgattttcacatcagtgcatccaagccaaaatatgctgagaatttttgccccctctatttggaaaattctgtatgacctatgcttttggtgtcagaaaaacagcatctcccccacacacttttttaaatggcctagttatgaaaaactctatcaatattttgaatatatacagaaagttcctgggctatcttaaatacggcacttagataatatgataaaacttcatctaaagaaaatagagaattgtaatgtgtggttttaccaggagtccaccaaaagtatcttattttctttttacaaaattaaagtgaaataataaaaacttttcccaccaaccttctaatgcctaacattaaactttgtacattgcagtaaagcccacttaatacttaaaacacactctgccctctctaatacaaataactcagtccatcaggggatgagtagcacagcttggtgtgtacacagctggaacaccaggccaccactctgatgtgaccatgtgtgtcactagggagaagaggggaacaaaaaacagggttacattaacagcaacagcttcattaggctgggggaaaaatagagtttacatagcttggtttttccaagcaatcagtccagtttgatccaaagaaacaaaaatatatactacctcaggaccaagcaaatggcattaatggataaatattagtgatgaaatactattttggttatgcaggtaggatatgaatcattttaatacaggtgtaagtatcttttactcttggagtgaattatcatttgattttataatttctttttatagtttttcataacaaattcagagacaagaaaatcagatataagaaagagataataacacttggaaattaatattaggcattaactcctaaataatttctaatctcagctatgtttctaatttctacttcctaaagacactttgtaagtattcctggcacagtgatgaaacaactgtcctagaatttgctaggctgtgacttaaaatatactttcttatgactcataatatctacaaaattatatttcttaaagcactttgttttttgatttgagaataataatattctcaataaattaaaatgaaattttagcacattaaaataaaatctagtaattacattttatgaaagtactaaagaatctaaagtttccccaccagattttatttccaatgttttaacatatggaaaatatcatcaattatattggtcaatgtcctttatattaagtctaatggcataaatttctctcagaactgagaactagaaaaaaaagaactgctatgatttttgtcattacataattagaattatacaattcacagcaaagtttccctctttgctgtggcttccaggcaagcgcagagctaaaatttccgcttaactgtaatattttttcttcagtatagattttctaatgtggtgaatataatttattgcttaattattttcagttattttaagtgtatgtttattataaaatgctgctttagatccttttgatagtagctggcatataaaaaaattaaaatgttttcactagaaaaatgctaccaaagaccaaaagccatgtatgtaggtataacaagaacattcagactatacatattgttaaatttacccttcgagtaatctttaaagaatgatagccaatgttcaagcccctggatgcaggcacacactcagtttataaatggagatttttatcttgggcccaaatttgcaaatgcatggaaaatcaggtaatgcaactgagatacaatttttaaaattaaaattgtcctatcaatatctttccaggaaaacttttttctaagtagaaaagaattattacaaattctacatttcggaatcagtgataagttcagctcttaatgtgaatcactatggcaaaatcaagataatctgtccatttattatgtaaaaattgttcatattagatttatgatgctcagtgtagggaattaagaaaggcatttgggtgccaatgttttgcaagagccactgtactatatgcaaatgctaaattcaatatatttttcagatatggctgatgaccttctgcaaggttgctgcatttaatttgcatgatactgatggtgatgcacaatggctgctggttaccctaggtgcctaaatgtctctactgcaacaggtcacagagtggtcctaagatggtgacgccacctctggggagaatcacaaaggttctatgcaacaatctctacggtagtcacacacaccactcactgtggcaacaaacgtaaaacatcaagcaatctctaaatggttcagggccctaaaaagacaagtaagggatcaaggaacctatgttctatttttcctctaattcaacaggataaactatagaaattctttcattatattatagttcaaaagcaaaataagaattacatgtagaacttccatgtcagaagaagctaagattatatttataaattttcttcatattaaaatatgattgaatcaatgagatcattctccaaaataatttcaataagagagacctggtaaatgagaaatattcgacaatgaggttatgaatttctacaagtcttgatttctaccagtctgaatgctttttcttaaacatatgaccttagatagataccagactgaacatcttgtatgatggtggtaaaatttaatgtgcacattagcaaatttaagtatcaaaatataatatatcctgccattgaaaatcaaagtactataacaaaaatataatatagacaaaataattacctaactgaaccaaataaaatgaggagactacttcattgttcttggtgcatttctatgtcttatcattgctctttaaaacagaaattattagaataacaacctataataattataaaacatattcaccaaaagggagtcccctagttggaacgattcaccttaaggttggtaactatactttataataatgattttctaatcagcatacaatgtactacatatttggaagaagtcaaaaatagattttaaggaaactgtactcatttaagaatctggtggaagggaagagcaaacaaagccatagatttcaaaatagatatttcactggtcctcttttggttaagtatttctaatagccctttttacaaaatggcctccattgctaaactagaatagccacacattaactgaaaatcaaatctctaactgaaaatcaaattaaaaaattatacaatctaatatttaatacgtttgttctgcatcaaactacaacacagtgatttgaaaaagatctattttgaaaattatatgcctactttgtttccttgaaatttgtgaatgaatttagaacttaaaaggtattatacattacattatttagaccacaaccatgaagagatagattttgaaaatttaagacttacctgaaggaaactttgaattaatatcctcagtaaataaccaaagataaatacaaattatgagtattttggtacacatgataagattttttaaagtacagctcattgctaaaactttaaaaaattgtattctctaagaacgactaagtacaacatacacaaaattattttccttttgagcaagaatgcatttagcctgtttccattgcttactggcattcccttgacagcaattccaattagtaaaacgttccaagaaagacacgaaatatgagaaatacaatcctaaattacagcatttgaggaggtcatatagtcctcatacttaatgtttcaataggaagaaattcaattaatagcctcattgtactatccctgtggctttattatacgtaatagaactaaaatttcccttttgttatgattggatgaaccgcaccctatatggcagacacgactcatgcaaaatcacaaaggttccctctaaatttggcctccacttgtatcggcttcccatagcagcccccaaataataggaagttatgcaaattagtgtattttattttatccattatacaattctactatgcaaacaaatcctacactgactcagaacccatatctcttaccatgggaaaacaatggtaaggtttaacatcatatttgaaagagaatatgaactagacaatattcctaataaattgaatggctaagagtcaaaacaccagcatatatttcataaaggctctaatgaggctggtggcaaaaatataatacacgatgatttaacaggaaccacctaagtattctcgtaccatgggcactacaatgactacctttttaggtagcaagccagcgtaaaacaagttgaaaataattgtactgtaaatgtataccattgacaacaaaacctgtgctgtgtatattcatattgcatcagttattctctgaatatagaagacaactcaaggtcaaatgaaaaataaccaataactcctattctttgccttaccacctcccgctgtccactcaaaaaaattaacatcttacttaattagtagtgtgtttatgtttagataatcacaagattgttgaaagacataatataacagaaggtttgttttgtttgaaaattatattatttgcggaggaagaataactacaggaagaagcttgtgtggtgtggttagcatggttagatttcaatgggaaaaggggtatttagacctagtatacaatatgtttttattagaaaagaacattatctttttattgttatcaattgctcttaaatttttctttaatgcaatttcacagcaatctcaagaggatacactaaaggcccttgattatatatactctacagaatgtattgtatcacaaagatacacatccaataagatttcttttttcatctgaaatttataaagataattttccatgctgacagtgcacatttcatccacaagtttgaggagtcaaatgctaccacagctgggggttattctgccaaatggcttccaacagggactacagagatgtgggctaggaggcatgtgtgtgtgcaggaaaaagcaacagacctgatgggaaatagcccttctctggagtcatttttatcaattaccatctgagtgatctaatcaaatatagtctaatgaaaacagcaacactaggaaggaaaagcaaatattaaaacagctgcttgattacctacagagattaaaacaaaaagcaaggagtgaggctgatatatttcatagggatttgctaaggctgaagggaggggtaaggggcagataccttaaaaaaatccatcatgaaaggaactgagacaagatcataaaaaagggggccaagttatagcgcgccatgggatttttaatctggctacctgtggtttctgtagttaaggctttattcatcccaaaacgggggggggggggggtgggggggagaaaaacaaaaaaaaaatcacatttatatgtcagttttgcaaatgatcaaacagcgtgcatcaataagaataataagaaaacattaaacgctgatgactttttaaaaacagatacccgttttatcaaatattattgataattacctgtgcatctcgtttcttgaactcctgaatttgattttcgtgctccatattggcagcgcgaagctgtttttccaggttttcaatttcccgttcatggtctcggactaggctatccttctctgcgttatgctgctgtaataggtgcgtcttctcctgttcatgctccagcttcagctctactatctgattggacaatgaggaggacagttcatcaacagaacatccttgtcgtcatgacaactcatgtacagcttaatttttctctaatttgtccaagttgaaaatttttatttttacatcattattacctcaccctcgaaatactctcatttgttggggtggtggttatgcaaacctcctaatattcaaaatagttgggcatattcagtaaatccttcttcaatctgttgacacaaatgtctgaacattgaaaaaaattatctcgaatgctagtcacttcctccccaagaattcgggtattactgatcagcaatggttataaatggttaatagtacgctttgctttttgcttaaatatacacatgtaaaaagcagcaattaaatcggtcagctttcttcatgatttacaaataaaagatcggagctaaatatgcatctggattcttgtatatacagttgtcttttaaaaaataaaatgataaatttcaaagctctattatctcgttgtcagctacggtataccaacataaacagatgttatgtgttccagaagggcacctgctgtgctgcaagcttgcgccatgatttcataaagagcattctattctcaggatcctttcccagtccactccacactggagactgtgaccttggccagtcttagcctctccccgctagactgaatggcagcccgagaccaaggcctggttgccgcagctttgatactaatcctcccagactgtgcacaatggcaccctacctggcctgcaaactatagccagccaggctgtctttgaagcaggtgatgaataggggacggcaggaagccagcttccccagtgaactccaggccacacagctgctaagaacagtcacttggatttttcttcagttttggtggatttcagggggaaaaactgctgttatctagaatatgttgtgttattttcggcgtgagaatccatcttcaaaaaagctaacagtaggagcctgctccaaatcgatcttgtttcgtgcaatgaatcaccagactaccttatcttaaagctatagcattcatttctccaggcatgcacactgcactaaatttcagaagttttctttttaaatttgaaattcttatcccttatgacaagtcaagaatcaaaacacaaatgaaatttgctttaaaacataggtttcaaaatgttttcttattgtgattaaagagtagcgggtaccattccttctgaaactattccaaacagcggaaaaagtgggactcctccctaattcattttatgaggccagcatcatcctgataccaaaacctggcagagacacgacaagaaaagaaaatttcaggccattttccctgatgaacatcgatgcaaaaattctcaataaaatactggcaaaccgaatccagcagcacatcaaaaagcttatccaccatgatcaagtcggcttcatccctgggatgcaaggctggttcaacatacgcaaatcaataaacgtaatacatcacataaacagaaccaatcacaaaaaacacatgattaactcaatagatgcagaaaaggcctttgataaaattcaacatcccttcatgctaaaaactctcaataaactaggtattgatggaatgtatctcaaaatattaagagctatttatgacaaacccacagccaatatcatactgaatgggcaaaagctggaagcattccctttgaaaaccggcacaagactctcaccactcctattcaacatagtattggaagttctggtcagggcaatcacgcaagagaaacaaataaagggtattcaaatagaaagagagaaagtcaaattgtctctgtttgcagatgacatgattgtatatttggaaaaccccatcgtctcagccccaaatctccttaagctgataagcaacttcagcaaagtctcaggacacaaaatcaatatgcaaaaatcacaagcattcctgtacaccaataatagacaaacagagagccaaatcatgagtgaactcccattcacaattactacaaagagaataaaatacctaggaatccaacttacaagggatgtgaaagacctcttcaaggagaactacaaaccactgctcaaggaaatcagacaggacacaaacaaatggaaaaacattccatgctcatggataagaagaattaatatcgtgaaaatggccatgctgcccgaagtaatttatagattcaatgctatccccatcaagctaccattgactttcttcacagaattagaaaaaactactttaaattttatatggaaccaaaaaagagtctgtataaccaagataatcctaagcaaaaagaacaaagctggaggcatcatgctacctgacttcaaactatactatgaggctacagtaaccagaacagcaaggaactggtaccaaaacagatatataggccaatggaacagaacagaggcatcagaaataatgccacacatctacaatcatctgatctttgacaaacctgacaaaaacgagcaatggagaaaggattctctattaaataaatggtgttgggaaaactggctagccatatgcagaaaaatgaaactggatcccttccttacactttatacaaaaattaactcaagatggattaaagacttaaacgtaagacctaaacccataaaaatcctagaagaaaacctaggcaataccactcaggacagaggcatgggcaaagacttcatgactaaaacaccaaaagcaatggcaacaaaagccaaaattgacaaatgggatctaattaaactaaagagcttctgcacagcaaaagaaactatcatcagagtgaacagacaacatacagaatgggagaaaatttttgcaatctatctatctgagaaagggttaatatccagaatctacaaagaacttagacaaatttacaagaaaaaaaacaaccccatcaaatagtggatgaaggatatgaacagacacttctcaaaaaaagccatttatgcagacaacaaacatatggaaaaaagctcatcatcactggtcattagagaaatgcaaatcaaaaccacaatgagataacatctcatgccagttagaatggtgatcataaaaagtcaggaaacaacagatgctagagaggatgtggagaaacaggaacacttttacactattggtgggagtgtaaattagttcaaccactgtggaagacagtgtggcaattcctcaagaatctagaaacagaaataccatttgacccacaatcccattactgggtatatacccaaaggattttaaatcattctactataaagacacatgcatggctgggtacggtggctcatgcctgtaatcccagcactttgggaggctgaggcaggtggatcacgaggtcaggaggtcaagaccatcttggctaacatggtgaaaccccatctctactaaaaataaaaaaacaaaaacaaaaacaaaattagccaggtgtagtggtggatgcctgtagtcctagctacttgggaggctgacgcgggagaatggcatgaacccggggggcggagcttgcagtgagccaagatagtgccactgcactccagcctgggcaacagggccagactccgtctcaaaaaaaaaaaagaagacacatgcacacttatgtttattgcagcacccttcacaatagcaaagacttgaaactcactcaaatgcccaccaatgatagactagataaagaaaatgtggcacatttacaccatactatgcagccataaaaaatgatgagttcatgtcctttgcacagacatggatgaagttggaaaccatcattctcagcaagttaacataggaacagaaaaccaaacaccccatgttctcactcataagtgggagctgaacaatgagaacacttggacacagggaggggaacatcacacacaggggcctgtcgggggggtaggggactaggggagggatagcattaggagaaatacctaatgtaggtgacgggttgatgggtgcagcaaaccaccatgtcacgtgtatacctatgtaacaaatctgcaggttctgcacatggatcccagaacttaaagtataataataataataataaagagttagaaaatcaacaatgtatttctaaccataaatgtattgttatttagaagaagaaaagtatgcaaactcttgaacatatacacttataacaataatgtataaataataaggcaaaatgtattttgcatctcagaattgtgatgtgttatagtgaatttatatttatttaaaatttaggggttttccccatattattctactattggcaatattcagaaaaaatagtataaacattttctcctaatacatactataccgagtaagaaagttttctttatttaaaataaatgtgtatgctttgttctgtgtctcacagaactatgttaatcccaacaaaagagagatttcatattgtattgctgttatgacattttgctcaggaagctgagtgaatgaatgactgagatggaatatttttagttcttggacatgttatttctactcagcgttataccaacaaggatcattataataaaattataaacttaaatcaaaatcatttaagcatgtaacacactgaagggaaatgggaggtagaaagttctattgagatcttcttgaaagcctcagaaatattgggagaagggatgtgacttaaaattggttaaaagcaaaatattttacaatattctagaatgagaaaagtaaccaaatgagctataattggggcaaaagaattgcagaattttctcccaacagaaaacacatgactagaactagctgtgagatcgttagtaatgatacctccttgttctgtactctagtagtaatgtactttcacagtaactttctaaacagagacatttgaagtttcttatagactcatcaatgatcatgcccatgttcaaatttcactttattcatttttaaaaatcaggaaaaaaaggaaatagcggttatcacatttcaagcataaacataaatagtcataaatgattgttagtttgatattttgccagggcctattgctcatgattctacttaatgaacaaatctcaaggttgccaaagccttttaaatatcattcacttttacctctcctgcttgaacagagaataaggaggataattttcaatttaaaatgcaatagctcaggcttgtctgctaagtccaacactacatggctaacttctggatgtcatgagccctttctggtcttttcctaggcttccgcaccatcagcatcttctagcaagggtgtcttctccagataaatggtagggtccagaggagaaaccctaatgttgggggaatatcttgacgatggtattcataactacaaagaatgtcatcaaggtagatatgtaaataaaaagttttactggtgcctagccccatccatgtaaataaatgttaaaagaatcatctggactttccatttgtcctttacttgtggacacatctcaaaggtaaacacaaagtagcacatcttcttcatgttggactagtagatacttcggttgaccaacaataatgtctaacggagttaatgatgaccaggaggtggtaaattatggacattgtagaggacataaaagcagacagaacccacaaaatgaatattaaatggttaataagccttctaagttaaggggtgtggggcatctggacccataatacatgctacaagggagaactggatgcaccatgatcaaggaccctgcttaattaaggctggctaaggagttccctgtaataaaagagggaaggcttcaagttccataatccaaaagcattgagctatgagacagataacaatactgggtatgtgcccaccctaaacatattaaagaagactggcatgtcttccaggaacactggtagtgtcagccctcatgtgcaagcacctggtggcatatgatagtcctttgagaagctagggttgacggcttggtggttggggttcattgtctagaaaatactgggttgactcataggaaattgtcatttttgaggtcaaaacaggagatgaaaaagggaccggggcagtggctcacgcctgtaatcccaacactttgggaggctgagccgggcggatcatctgaggtcaggagttcaagaccagcctgaccaacaaggagaaacccatctctaccacaaatacaaaattagcctggtgtggtggtgtatgcacgcaatcccagctactcaggaggctgaagcagaagaatcgcttgaacccgggaggtggaggttgcggtgagccaagatcacgccattgcactccagcctgggcaacaagagtaaaactctgtctcaaaaaaaaaaagaaaaagggtcctgctccacccaccatgctactccacaacacatgcagaacttgaaattcaagagtaaagttttgaagttctgaagttcctaaaagcatcggcctccatttcagaacagacgaaatccttctacagcttgatgatgacgtcttcattccaattgaactttcatgtaagtgcctaagggcaagagcacattctaggtcccaagaaagaccaagatggagccactggacatacaagtccctagggatcttgggatatatattttaagtcctggtaactgttttacagtgaaattagtgctagcaaatatggcctgaaccactttcaataatcatttaaagaaatagaaaaggagatggaaaaagtcatttcttctcaatatacaatatgtggaagactaatataccccaataacataacttaatgtcaggaatgccagtgctagaaacataaatcatagaaggatgtaccacaacacattgaaaaggggaaatgatggtataaaatactaaccaaaataatcttgaaggtaatcaaattacaaactttatattctacatagccctggtgtaaaaacgggttatagctagagaaagtagggagagtggttctccatattctctggctagaaaaggaggaagagagggagtcacagttagatgccctggggttatatttgtcctacaactcaatgataattgctctcccttaagtgaatagaaatatgaaagtttaagaatttggaaggacttagaggctagctaatacaatgttaatcttaatctaaaaaccttccctataaaaccctgatagttggtcattcagctgctgctggaatgattttaccaacaggagaataaccatattccaagagaaaccaatgcctcatactgaacatacttggcactggaaattctgggtaaagataatagggaaaactgaaaattgtgaaaagaacaaaaacaaacattaaatacagaacatgagaacattcactggcagtgaacaaacaaggaaagaagaataataacttggccacaaatttcaaaacaaggtagccaaggaaagaaagagaagattctgacatggtttggtgagacatactcttttgtccctataccctagaagtagaactggtaagttgaaattatgctgaggattattttccagtatcccagttttagagaaaaatgaactgaagatgtatcattcacttttcccccttctgcctgggtggaagaataggaggacaatttcaatggagtaaaaatggctactagagagagatgaatcaagttaggaaagtaggaaacttggactgattctctctgatagaatataggaaggagttagagttcacagaaaaaagaaaacactctctaatacacagaaaaaccccagtgtaagacattaataaattgttaaaagacagagccagtatcagtttctctgacagaagttgttcagaactgcaactaagctctttttctccatccctatcacgatctcataaaaaagtaaaggcaatgaaatacctgtgccttcatactgaaattcagaggaggactgacaggctgaaaagtagtcaaagagaattcatgaatattatatcagtccatttaacagatttggacacaggtgcccacgttaagcccaagcaagatgagggagaaaagtatctgaaaactagagaaacattaattacattaggaaaaaggtgaacttagtgacaaagaagaggaaaagaagaaagtaaggaagaggcccatcattaaaaaccaaaaacaattgtaagagaacttaataagaacatgagtgtaatgaaagaataatgcaaggataacaagataaaacaacagaattaaccaaggacccaaataactccatcacaaaattgattctaaatcagaaacaatgagttgaataaacatggtgaaaaatcaaatcattgacatagataaagggtttgaggtaatcataataaaggtccaggaaaaagacaaagagaagctaaagtaggaaacgtgaaaagaaaatccatgtaaacacagaccgtggtatccgaaaatttccctaaaatgaatgaagagataaatgtgtatatcaaaaagacacactgtagaccaagaaagatagattccaattgaggaaaagaaacgtgaaagaaactcaaggactgtagtccccaaaccactcttgaaacaaaaaaacacttggggataaatttcaagcaagagatgaccagagaagctgtttaagaccaatgtttgcaccaaaaggcaatggatgatgtgtacaaagtgtcaggggaagaaaggatgatcaaaaaattttatgcccagctaaggtatccttcacaaataagagaacacatagtgatgctcaagcatgcaaaaatacagtgaatacaactataagcccttcttggaaaagctacttgatgaaatctcagtagtcaataatagatcaaaataagaactcaggtatgaagttgtgcaaaaatcctggtggtgagcacataattgatttaaataaaaagctaagtttatataactgtgagaattatggttatggaacaaaatataaatgttataaacttcaacaatgtataaataatactatggttgacaaaatagactggtataagtaggtggaaggaaatatgggcagtttaatttttctctaataaggagttaactaatgccctcaaaattgaaccacaaaatttaaaaattactctaacttcaatgtatttttaatttctaacattctaaaaataatctcttatgtggttaaaaaaatgtttttctaaattttagaaatctttccatttccactgggcacagtggctcacccctgttatctcaacactttgggaggccgaggtgagatgatcacttgagcccaggagttcaagatcagcctaggcaatgtatcaagaccctatctctataaaaaataaataaaaaagaaaaaatgagagaaatctttccgtttcccttgtttcttcaaataatttcacatataatttaatattttaattaaaagtggcaaatgtagcatggtcctgtttctagaaaattgtttttgtctatatatctacttatccttctatttatcaatctctcatagaaatttctggaataatgctcacctaagattaacagcagtcgtttccggaaggtaagatttgggtaaaatttttgttttcttctttgtgtgcaggaccatgtcaaatgccagtagctcccttcggggggaatatttacttctggtggcagtacaagactcttaaacaagggatgtggtctctcttaaaacaaacgggttctgggtctgcgaaccaactcagatcgggaaacttggtagaggactatgattttccaccctaagtggaaaactgtttcagtttcactcatcagtcttggacattttcttgatgttgtacaagccaagtagtattcccactggctctctatcttatctctcagaacacagctcattatcaccacagatccctgcagggtaagacacctgaagggcctgtctagccttactatccagtagagtaatcgtgtctaccttccatctatccaagtgccccatgtagtgcctgccattctggaacccaactttcctgttgaaaggaggcagctcagttccatagcagcatctcctactgtcggccccggaatacagaggaaaccaccatggaggtggctcagtgctatcagtgcccctcccaccagtgcaccttagcaccctagtaaaggccatatcctctaggccctcccatgcactggcttctctggcctaaagcaacaaaaccactctcatattctcacttttctgatactttgacccttcctccatagtaagccaaggcagttctgccatggctgaagtagcatggaagtaagtggcagaaaaactactgcctggtaaaaatcacaaacaattatcaacatgccacattttttaaaaataaagatgaaggacagttcaaacattgtaaactgtatccaaaattatattgatcatcaaattaatagttcaaggggcacattgctttaaaggattggccattaatagacagatttttctacagggcttgccaggtaacactttcctctcacgttctactcaagggctctctgtggaaaacctttgcttctaggttgtaaaatttagcactagttttattaggttggtgcaaaagtaattgtggaagtaattgttgtgtttgccattactttcaatggcaaaacccacaactacttttgcaccaacctaatatataggtcattagactcatgatgttaagatgcatactaagaaacaggcaacaggtacatcaggccctggtatttttcatgcaatgagatatatatttaacatcatcaggttatgtctctgaaaaatttgcatctgcaaaattgcacacttgaaatgtcaaaataagttactaaattttttagagctgcagaaattttacgctaatggggcagtctaccgcaaaggtagtagtttcacagactgattttatatcctcactaaaagatgttggaatctttctttttagtcacagttatatgatataaaatgtgctattggatacttcactatatgagaaaagctcccttaaagataaaataaggacatatacaatcttctctgagtccttggagtcagagtaaagatacattttagcacagaaaatactacaatctggtcttactttctgaacactttaatagaaataggcacaaaaaaattgtaaaaagcaggcagtgtgtcaagaacagaaatagaatgtgtcatttggggatggccatgtggctcccagattagatgtttgctacatccatgaaatctgtcaatcaacagttcagtttacgcatggaagttctccttatttaaaagtttaatgttgctgtgataaccgctgttagagatggtaccagggcctgccagcatacactgcttctttattccttttcctctccagccaaccatcaacagccaggactactgcctgctgaagctcccgaagctcatgatacagggagagcagaaggctggaaacacagctgtgattagcaagctgatagatgaagcaaggctggaagcaggcgctatctcctgtggttatcttcccatttaacacttcaaaacacttctccagcacctgtaggtgatgagtgacaattatcctgagtttttaaaactttttgaaaaatgagctattactttctgtggttttatctgccagatctcagttgaaactcaggaagaagccagatagtcaaatgcttcaaaagggtttttttttcatggttcaataatggacaactcaagccacacaaattgagaaaattaactaaatttaattaagattaattaactaattaactaaattaatgaactccatatagatggagttcaaaatttttagaaaaaaacatgtcttaactgcatattttaattcattttactttatgtgtttctctacaacacattcagttctcaatgagatgtctgtgtcttaatctagtatgttactgcttttgaatgaacatgaaatataaaaatcatgtaagtttgccagctacagttcgtaatttagaaggacaaataggtcaacctggttataaactcttccaatatatagcactgtgtctttactttctttttattttccttatcttgcctaccacaatgcttcgtaaattattcatcattttgaatgaaacaaggtggcattcgaaaaacagaattacaagtaggtggaagacagctgcttcatcttccccatcaccaaattggctggtccacctgcaaagaccctgccttacctatggcttgaacgcatggctggccttgcagctacctaaggcgagtcccttcatctgtacactggattccatcctttcttgccaaattaagcatgctgctcttgaaattatcccatcactctctgcatcatcaatattttcttctctagtggatcagtctcatcaataagcaaacatgtttttagcttatctcattttaaaaaaactttcctttgaccacacacgtccctctagataccactcatttctctgctcccttttctttcaaaattcctcaaaacggctgctcacaacgcattgtctgtccacccacataattcagacattggttcccacattctactgaaaccagtcttgttgaggtggctaaagacctcgccatgcagcagtcagttctcagtccccatctaacttcccttcttggcaacacctgaaacaagtggttactcacttcctccttcctgaaacactgcacacggcttatgggaaatcccaccttcttagaccttccttttacctcactggttgttccttctcagtctcttttgctgcttcctccacctcttcctcatatgtaagtgttggcagcccctagactcagtcctggaagttcctttctcttctctctactcatgtatcagtgtctgtcaccaccatccacctggttgctcagttgggaaacttttaagtcacattttagcccactctttaccttacattctatttcacaaccattgacaagtcctgcctgcaaaatagatcccaaatctgactactccctgtctcccccaccactcccaccctagtcccagcccggtaacctctaaccagcccactgcaatcatctcctaactaggtcccctgcatcctctcctgcctccatcgtaatcaaagctccacacagcaactggagagatctttcaaaaatgcaaactaggccgggtgcagtagctcacgcctgtaatcccagcactttgggaggctgaggtgggtggatcatgaggtcaggagttcgagaccagcctggtcaacatagtgaaaccctgtctctgctaaaaatacaataaaaaattagccaggcgtggtggtgggtgcctgtagtctcagttacttgggaggctgaggcaggaaaatcgcttgaacccaggaggcggaggctgcagtgagctgagatcacaccactgcactccagcctgggtgacagagtgagactcaaactcaaaaaaaaaaaaaaaaaaaaagagaaaagcaaaccagatcttgctcaaatgctccagtggcttctcaacacactcagaataaaatccaatctcccaccatggtccataggatgtgacaaaatctaccctgtactgtactttggctcctaccactctcttccaagttcactccattccagctacaaactaacccatctcatggctgttgcaaccatccacctggaatgttctttccttacctcaggtttttgtatggtttcctccttcacttcatccaggtcttaatttgaatatcatttcagtagagtccttcactaacaatcttatctacaataacaccttgtataaaataataaccatttataaagtagccctttcactcacaaacactttagcttgctctatttttcttcacaacagttatcattacctcaccctaccttaaattatgttttgaaaaagagtgtgtgtgtgtgtgtgtgtgtgtgtgtgtgtgtgtgtgtgtatgtgtggtaggagtagtggtggtgggtagtggtagtgtttttctcttccatcacaagggtaaagactctatattttgttcactgttatatcccaagcacttggaagagtgtttagcacatagtaattcaataaacatgtgtgaaataatgaatgattgagaaggcattagttccactttatatttttaatgtacttaaagaaggaataatgagttagtccatatcactatccaggaaaacagcttctttttttttttttgaaatgggtgggtggggtcttgctctgtcacccaggctagatggagtgcagtggtgctatcaaagctcactgtaaccttgaactcccaggctcaaacaaccctcgcaccttagcctctaaaatagcttggaacacaggtgcaagccaccatgccagtctaattttttttttttaatagagatgggggcctcactacgttgcccaggctggtctctcactcctagctccaagcaatcctccctcctgggcctcctgagttactggaaatacaggcataagccactgcacccagcccatctttgctcttttaatattcactctagctaaaggtgccacttgttttaacctagatgagaacagctccaggccaaaagaaaaaaaaagaggaagagaaggctcttcaattgcctttcactaaatatcagcaccctttctatgactctaggctccgaccactggacctggacacaggggcccaggctctatagcctcacagcctggggctctgagtctggcagcctaatggctgggaatctggtactttgccattgcctgcaggaccaatctgtgacttgtggtgtagctgcattccctgaatttggtgcttattcaaagaagtaagttgaaaggaagcatcattagatcaaggattgcatttgtcttgatcaccactgaggaccacaggggctgatatgtagctggggttcaaaaatgtattaggaattggaagaggaaggtcaagcaaaaaaagactttcaaaaagagtatgataaggtaagcaagaataaaagagagtaagagcagcatactggatgtaccataaatcatacatatctagaaatcaataagtcatatggtaatccatttggaagggattttagggagccccacaaatccatggtcatttaccacattacctcaataccgaagagaaagtttacgaagtctttctacttggatcagtcttgctatcacccaaataattttaaacaattcccacttttatttgctctcctgtccatgtaattcctccagtctcagcaaatgattttgccgcctatctgacaaagaaaaacctcagtaataagaatgtcttcatctgccttttgcagatccacaaacttctacacacctggccttcccttcttttctcacgaggcacaggagacagacctggccatcatccaaggccagcagctccccacgtgatgtggggagctgcccagtatctccaccttcttgggaacatacactagtgagtgtcttcccctttcctccctctcttcctttccaccatctccttttccagtgtagactaaatagtctcatttaaaagaaacctggctgggcgcggtggctcacgcctgtaatcctagcactttgagaggccaaggcaggtggattgcctgagctcaggagttcaagaccagtctgggcaacacgatgaaaccctgtctctactaaaatacaagaaaaaattagccaggcgtggtggcgtgtgcctgtagtcccagctacttgggaggctgaggcaggagaattgcttgaacctgggaggtggaggttgcagtgagccgagattgcgccactgcactccagcctgagtgacagagcaagactctgtctcaaaaaaaaaaaaaaattaaaattaaaataaaagaagcctaagcttgaaggttataccacctagctaagtaatgactagaatatttgcaaaggacaaggattgggaatcacgtgctatctgctttttaaatatcccaactgaccttcacttaaaatttcctacttgcttatcttgcagaatttgttttgtctttgctactgtgtttgctaacaaaatattttaagttttaaataatggcagcttgtaagaagttggcccttcagtgttttttgttttttgttttttttgtaatcattgacaataagcacttattctttctggagaagctggccacttgtttatctgctgaactacatttctccttcaaggctttgtagtggaaagcaaagatataaaacacaagattaaagaatgatctcatggagttgccaaagaaatctctatagtccaggaagtcctagcatgcctggttggttgtttgtttccaacttgaatgaggtttgtgaaaagacaattagaattgtctttttgttccaatgggttatacaggaaagaaacaggaaatcttgatgaaagcttgggctttacaggatatttgtgtgagcatttagcccatgtgtttgatgtttttctttccacatctgcacactttatgcctggattttggctaagatactttaaaatactacttcgctgttttcacttcattacagttcctggcacggtgctttctgtaagagaggggctcaaaaattaaaactggagaaggaaactgaggcccagaggcacaagtccattcattccctctgaatgtcagtcagttccctcgttataaaatgtgaggattagaccggataagtgcttttaaaacttttccaccaaagtactctcagcagcagtgaaaatgaatagcacccccctgggggatctgagggcatagcctgaagcagcctctgcaagctggaagtttctttgaaatgtcctattttgtcttcttcatgagaactttgcattttacaaaacaggaaagtctatgtttgttttaataggaatgttacctcaatagtaaaactacgttgctttcccacaatcgaactgagtggatgcaacactccaggaagcatgtacgcagcctcaggaacccctggcacttgctcacactcccccggggatcaccttacctgagttggagaagcaagggcccagatgctcggcgtctaaatcccctcctgatgtgaaatgctatcatcataacactgacaattttaccttttagagaaaagtaaaacaaaataatagaaaaatattcacacttccatttgaatggcaactgagaaagtaggcaagagtcctgatacagggaaatccagccagacaggtacctaaatgaatgagtcagcggtggaatcagagaagtcggtctgtcaagaggggctgggaatctaatcaggcagatgaacagaaagtcccagaatcttggttttggaagagaccactgcagtaagacagcccccggaaggcacagtatccctccagaatactccaaaaacacaccgcaacccactcacactggaaacttactttctcacaagaaaaactgttgcacatttgaaggaggagttctttagaaaagaactaccttgaaacaattcaaaatattcctcatggtaccatgtatgtatgggttcaatttctgccccctggaactccgcgggagtgcatttagagtgggggtcaagggcaggcctcaggttcaggttccgaatccaccacctatgaactctgtgggaccctgggccatttactcaaatggatgtacttcagtttctacaactagaagatgaaaacaataaacagtgtagctacctcacaagatttctgtgagtcaggtgcagtggctcacgcctgtaatcccagcactttgggaggcagaggcaggtggatcacctgacatcaggagttcgagaccaacctagccaacatggtgaaaccctgtctctactaaaaatacaaaaattagccaggagtggtggcgtaccacgtgtaatcccagctacttgggaggctgaggcagaagaatcacttgaacgtgggtggcagaggttgcagtgagccgagattgcaccactggcactccagcctgggtgacagaccaggactctgtctaaaaacaaacaaacaaaatatatatatatatatatatatatatatatatatatatatataattataatatataatatgcattatacatatattttatatatatatattactgtgaagatggggagtggctgaatatgtgtaaagcaagcagagtagtgcctggtccagggtagatcctaataactgtgggcttttaggatttttatcacacagaccaagcccagtactccctgaaattcagaccttaaatttacaaacagagagatatgcaatcctccctttaaatattcccctctgacatagttccagacctttctacactctgaaaactcttctctgaacatgttcgagtttgtcagtggcctgcttaaaatgtggtgaccaaaatcgacctattccttatgtgacctgaaatgtaaacaatagctgggaccatatctgccagccctcttgtcccctgtgtcccaggcaccacactccccttatctctgaggctttctgtcttccttctacttttgcaactgattttctaaaccaaaccatggcattttatattcaacctcaataaatgtaatcttcttaattccagccagcttaaagctgcagaaaactcattttttttaatcctacatattaactattcctcagaactctaagcattgggaaactttaaactttttttttttaatcccttatcatcctcgactgactgagagacacagaaatctcactttaggttaacactaatcattcagagatggccctttgaactatcacttaaccacataaaggtaccaatattcaaaccatatttccccatactgccttcatgtaggcaccgtcagacggctccacgaaagccagatatattacatctactcctatttccttatctaccagcctggctgccctgttcaaagaaggaaatgagcttagtttaatcggcttcattcttagtgtactcatgctggcttgtagagctcactactgtatgcctatcgtttgtcatgataaacttccacaggaaaaaatcctaacaatttggagtggtcaggggaaacactgttacagttaacagaatattctgctgaaaaaaaaaagctaactaaaaaagtttgtatattgtcacatcaataaatattctcctaaaatgtactagctcatactcctgccttcatctttccttagtgaactaccacctgggatcttcattctcagcattgattctaatgtatagacctctagatatagaaagaataaaaacaggtgaaatctgcacccacctgaggtacgcttgtgtgtgtttttacattcctgttatatactacatttgtatcatctcttttcatgaaaaaaagaaagaaaaatggatgcaatggtgtatggcttccattaatagtatcaattctttaaagaatttatcggtatcccttattgtgttagtattatttttgatcaatacaaagacaaaactttgatagattttaaaatctatcattctgagaaaagcctttgaagtttacatgcttccagacaaatttatatattttttttacattaaaaaagtgaaactgtcacaatgtggataatagggggtatagaaaaaaagaattcaccatgattccatcctctaaaaaataactaggatttttgagattaaggataattgggtcagagggtgtaagcgtttttcatgactcttggtagaatctgccaaaatcctttccaaaaagcctgtaatgccactagcatgtataaaagtaccaatttcactaaacttttaccgactttagatggcacatcatggttaattctaatttgcatttttattaacaccaagagtaacgatgtttctacatggctgttcacttaattcatttcttatctctctctttcctttgccaggtcacttattgggacattaatgattttcttatggtttatgctaattactatatttaatctgctaattatttttatatattatacatttattaattttataaggagagttactctttgcctaagatatctgcttcaattatttcttcaattacttttttaactcaaaatactttttatttagtcaaatgcatttcaattttccttggcgtttttttcttattgtgtctgactttcaaagtcagtggtgtgccaaaacaattacaaaataaatgcagatcaggtgctgacatcatttggccacacttggttataaatttgtgacccatgtgattatcatcaaaatgagaatataattttaaaactcccacagagaactctgcaacatcttacactcatcctgtagtatcataacctctgactagcatttgtgttacataaagagctttaaatttggttttcccttctcccctgttccttcctcagtttacttagaggaactgacatttttcttatttttcttagtgcttctaatattgtttttaatacaaaattacctcaattatactttgtaactatagcataataaaaagtaacattcattgcccttccttaatatttttatttacatttgattattacctctgtttccctcttaccaccccttcctccccaattccagcctccaattcttcatctagttttctaaacctagtttctgaaaccagtttccaagcaacttcccccatcactaaagttgtggaaaacatcctccatggcacttcagataacagtgtatttcaggggaaatacctatttttaatttagcatgtgtcagaacgactttcagttgccatcccatattaatcggaaattaactacttcatttttatataaaaccatttttttaaaaaaaagaatctgatagaataactccattgcaccggcttttgcagttagaaagtctgaagttatccatactttggcactgttgaaaatgatctgtcagctctatcgtctaccttttcttctcttttaggcttttcatttgttggtcattttttacattgcatataaattgtctgaatttattttctatttcattaatccaaatttattacccacttaaaatgttacagaatataatatagaccaggcacggtggctcaagcctgtaatcccagcactttgggaggctaaggcaggaggactgctcaagccctggagttcaaggttgcagtgagccatgatcatgccactgcactcctgcctgggagacagagcaagaccccatctctaagaaaaaatatatataatataaatgctccaaaatattattccattttaatgtttcttagcattcataattttaatgttttacttatccaagtaatgcataacatatgatcattatgaaatttgaagtaaaaaagttttatttagagcatacaatgaaagtctcagttcatcataaccctaacccataataccaggccaattccatagtcatgtataatcttacagaattttttcactgaatttacatatctaactttgagacacatatgttttaattttacttcaatgggatcataatatacaaagtgttctaaaaagcgctttattcccctcaccaatatgtcttagaaatctgcatatgttggcaccttcagatttatattaatctttttaataagtatatagtattccacagtaggtatttagcattatttatttatttatttttgagacagagtctcgctctgtcacccaggctggagtgcagtggtgcgattttggctcactgcagactccacctcccaggttcacaccattctcctgcctcagcctctcgagtagctgggaccacaggcgcccaccaccatgcccggctaattttttgcatttttagtagagacggggtttcgccatgttagccaggatggtctcgatctcctaacctcgtgatccgcctgcctcggcctcccaaagtgctgggattacaggcatgagccaccgtgcccggccagcataatttatttaatcattcattttattcataacttttttcagtattacaaataatcctcccgaaacatatgtgaacatgcatttttttgcacatgtataagtatttctataggataggttctaagaaataaaattttgggattaaaatctatatgaattagtttttttggaacaatagaacatatatatcctacatatgaatatgtatatatagagtgtacatattcacatgtgcatatgtgtctgcatacatgcacacatgatttttaaaaataaaatggtaaagatcatcttctaataaaaagtaacaggtccttgccccatcccactcctgtactggtggcaactcttttaaaacatgtctgtgctcctttctgtggtgattacttccctacctctacaaaatatgctacatagctctttcttaatttaccaaagctagacattccttataggccttctactaggacaaatggggatttagctcatttacactcccttgctgctctctcccactcctgtcaccattttactagttactccactcctctcacttcctccagtggtcaaccctgtaattaggaatatactaaagcctctgtgttttgtttcatgatacgggcagctgctcaaatccacacttcatgataatacctcagtactctcacccttcccctcccagcccctccatccctttcttccacttccatacctacaccgtcttaacctttactgttacaatagcaaggctggtgatatggtttggctgtgtccccacccaaatctcaccttgaattgtaataatccccacgtgtgaagggcgggaccaggtggagataattaaatcatgggggcagcttccccccgtactatactcatggtagtaaataagtctcacaagatccgacggttttataaatgggagttcccctgcacaagctctcttgcctgccaccacataaaaggtgattttgcttctccttctgccatgattgtgaggccccctcagccatgtggaactgtgagtccattaaacctctttcctttataaattacccagtcttgggtatgtctttattagcagcgtgagaacagactaatacagttggtaacatctatgtcctgttctgtaaccctaagctagtttttaaagctgaaaacaataaatgtcatctaattattatgtctatgtatatactgttcactgatgaatattttgtctgctaagactacatttccttttctactggtccagcatcataacgcctgtgctgcttgatgaagaatgtgcctttaaaatccagttccagcattttctacgtttttacattttctaagtttgcaatcgtagtcagcatggtaaattgttttacgctaaccccatttgatggtcttctctgtgatactccttccaggcggaggattacaccagggaggccatgtttgctttggccaataaaatgtgagtaaacttacttctgagtcaattttagaagacagcaaatgctcaaaatatttccttttccatttcccatagcaatgttccagatagttcattctaaaaacgactcaagatgacatgacatgggtcagagctgcagtcaatcctcaaaggacacgtgacataagtatgaaataagccttttttgttctaagccactgaggtttaggatcatgtttaccaaagcaaaaccaagctaaaaattaatggtaatcttaagtattctgggaataagcagaaatatatttttaaaagaagaaaataaaactttgtattactaagtaagaggcagagcactgacgacaaaatctcaactccttacacaaaccggtcctaacctccctctttcccttcatctcctacagcaggaacctttctccccatactctggctaacctggtcttcatcatcatttattttccttgaacacttccagcttgctctcttctcaggatttttgaacgtgcagttccctcagactggaatactattcctccagagctcatggctggctccttcctagtttttagaactcagcacaaatgtcagggaaaccctgatcagttattcaaggctataatctccttcccaccctccacctggcaaaggctataaaggtaccatcttttcttcttcataagtcactcttcaggccgggtgtggtggctcacacctgtaatcacagcattttgggaggctgaggtgggcagatcacctgaaatcaggagttcaaaaccagcctggccaacatggtgaaaccctgtctctactaaaattacaaaatttagccggacgtggtggcgtgtgcctgtaatcccagctacttgggaggctgaggcagaagaatcgcttgaacccgagaggtggcggttgcagtgaaccaagatggcgccattgcactccagcctgggtgagagagtgagactccttctcaaataataataataataataataataactcactcttcaaaattatttcactttttaatttgtagactgatgactcatcgaaaagcaagctccatgagagaggaggcatgttctctctgttgctgttctccctcatgccagggacagcacctggcacatagtaagtactcaaccctatttctcaaataaatggaggtttaactagtgctctgacaggatagaagaatgactgatattgttaggatacttgttcccacccaaatctcatgttgaaatgtaatccccagtgttggaggtgcggccttgtgggaggtgtttggatcatgggggcggatccgtcatgaatggcttgggccatccccttggtgataagtgagctctcactctgagtttgagtgacctggtcatttaaaagtgtacggcacctcctcgcttctctctctctctctctcactggttcacttgctggttcctgcttttgccatgtaaggtgcctgcttctgcttccttctgccatgattgggagcttcttgaggcctctccagaaacagaggccactatgctttctgcacaacctgcagaactgtgagccaatcaaatctcttttcttataaactacccagtctcatcaattataatcgatgtttcaatcaaacattcagataaaacaaacagtcagaataaacttcagtggagtgttaaaattctgtttatagattttattgaaacaaacattattttaaatatattggtaacaacagctcttagtaatattttcattatgcagatattttgtgatagtgatttttaaaagataaatcatatatgtattttaaaaatttaatggcagcatcaaaatgaaagaccaacctgttgttcataccgctgtctgatgtcctccagttgccataaaaactcctttgattgtttctcacgaagagatttggatctagttagatctgcctccactttttccatctataaaatttaaaaatcaaatattaattttttaaacaaacaattgtgttccatgtttttgtaatttgtccatttgtttaaatgacagattttaagcacctcaccaataataatgatgaatttaaatgtattaaaataatgagacatttatcaattcattttaatatattttaattatttaaggagggaaattaaaattggtatataattgactaaattctaaaattacaacaataatgcagtgaaaatataatttaaggcattctaatatttattgaacaaaatttaattaagcccttggtatgtgctgaatgagataaaatatttccaaatcatatctctaataagagacatatcttgaatatataaagaactcttatagcccaataataaatggataattaaactcaattttaaagtgggcaaagagcctgaatagatatttctccaaaaagatatacaaaaggccaaaaagcatttgaaaagatgctcaacatcactgtctttaagcaactacaaattaaaacaagaatgacatatcacttcatgccccaaagaatagcaataataaaaaaggacaaatagtaacaagtattggtaaagacgtagagaagtcagaaccttcaacactgctgctgggaatataaaatggtatagacatgctggaatacagtctgtctgacaattcctcaaaacattaaatagagttacatgtgtcccagtagttccactccaaggtaagaaatgagaacatacatccacaaaaaactttgtctacaaatgtttatagtagcattattcataacatccaaaaagaggaaaccacccaaatatccatcagttgataaatgaataaacaaaacgtggtatattcttacagtagaatattattcaatcataaaaaggaaagaagtattaatacatgtactctgggaggctgaggcaggaggatcgcttgagcccaggagtcggagaccagtgtaggcaacatagtgagactgtgtctctacaaaaaagaaaaaaaattagccgagcgtggtggcatgggcctacagtctcagctattcgagaggctaaggcagcaggatcgcttaagccccagaggttgtagctgcagtgagccatgactgcaccactgcattccagcctgggaaaaagagtaagatcctgtctcaaaacaaaaattaattataaatagaaaaaaaactaacacatgttataacatggatgagccttgacagcattaagctaagtgtcacaacagaccacatactgtaggattccatttatattaaatttccagaataggcaaatccatagaaacagaaaacagattagtggttgcctagggtgagatggtgatctgggacggtaactgttaaagggtatggtgtttctttgggggaagatgaacattttctaaaattgattgtgatgatgtttgcataacatcctgaatacattttttaaaaccactgaattgtacacatacgagtgaattgttggtatgtgaattttatctcaacaaagctgttattaaaaaagaaagcggaaaaaggaaaagtcaaagattccaccacacccatgaggcctcacataatccaatcccagtgacctctcacagctcatctctactgctctatcccactaccaccaccacagtccacctacctgctgcccaggcctataatgtgtcagaagtgctctcaccttgtgggcaggaggttctgcctgatattcacacagtttctttctcaaagtattgaggctttgtttagcatcacctttgtactgagaccttctagaccactcaattttaaattgtacattgcaattccccagccactaagtccacctagtccccctatccctgcttagctacccttttgttccacaggatatatcaccttcagattcactatataatctacatcttcattagggctgtttgtaatgtctctcctgcagtgtaatgtcaccccatgttcactgtcgtcagtgaaatagtatcaacgatttatcacagtgcctggcacatacagggaatcaataaatactaatcaaatgaaaacaaagattgcacagtgtacccaacttggttcaagacttgctgaatttacaatttccaacgtttagttccaaattctttaaaacacacacaaaataaataaaagcatgttggatctaactttttctatcactttgtccatgttatgatcagatgcaatgagaaagagatgttcttacagtcatgaaaaagctctccatgtcaacaacatgaaaatggtgccttttattcaaagcaatgcagtattttacttgtctttaaacccctgcacatttgggtataacttaagacaatattttttgtctgaggcaattaccagctaacgtggcaaccattctaccactggctactttatattacttattattctgcttcactggtatatggaactacttgtactttgttcagcttgtacacaatgccttctttcaggttaccttttggtaagcactaagattagttaagacacgaatattggaggaaatgaactatgaaaaatgcttctttcacagtttttcacaatatatttgaaaaaaacatttcaatgcatttattcagacatgattagactttaaggttctaggaacaaagatgttcagtgaaaggcaacgagtttcactgcatgagaacaaaatgcatattaccacccactactgtgtctaacaccacattccagtttctggttcttacattgaagtttgaatgccctctagattatagcatgctatttagcacccaagtatttctttgtaaataccaaggattgcaatcccaaaaatattaagtcatcagtgtaaaattcaattagagttctaagattactgattcatagataattagtattgtggtcaagaataaatttaaggaatgattaaaggaagcacagtcaagcacactttggttttttgtttctaactcaagactttggtttcaagactctctttctttcagtgcttttcatattggacctcaagtgagattctccttaatctgtcctcggcaatccagactccagtacccttgatattttccaagcaagccatggctgttcttgactctagggccttttgcccatcatactatcagtaggtcttttcatttttttttttcatccagtcagtcttttcaaagttgactcaggttttccttcttctctaaggtgttctttaatcccactaactgaataaatgccttccttctctctatgctctaggacttaacatctttattcttctagcacattgtgtatttctctataaaatggaaatgtttcaaatatgtaagctttgtttagtaatgcagataatgagcccacaaataaaagaactatggcaagtctttcttttgtatatttattaaatagctgccatggtatgcgaagtaaagatgtattaaattcttaaggatgaggaggagggacatcagcaagatggtagaataaaagttccacagctccagtctatctcatagaaatccaactagcaacaattcacagacaagaaaaccttcgtgaatattccagaacataggagtgaggctgacacatgctcttggattacagaactaacaaaagtcacattacaaaaataatagaaatggtttcacgttgactgtatcatctctcccacaaaccaccatagtgccacacagagaggattcccctgggcccatggtttctacagtgggaaagaggtgaacatccagctttcccagcattccaagatgtttggcaggaggcccacttctgcctcgccttaaaaggaacattgggagtattagcagggctagaacatctgagatcagctataaacaatgaagggaaaatggagctcacagcaacctctgcattctggccagtggaggcacccaaccagagagaacaacaaatagcatcactgagcaggaagcacagttgacagatctgccaagctcaagtccctagccagatttgccacccagcctcagagcttggcatacttccccaggctcagaggcaagcccagatccctgcatatctgcagagcagagcatgtagtccaatacaatcttagcagtgattgcccctgtctagtgttggagcccagcctgaggtgcaggcagggagccaagcccaaaactacacataattgtgggcatagcatctagctttgcccatctgagtggctggctgagcagcaaccccagagaccttgacagcattggagtctgaccttcagccctgtccaactacagatttcaaacatgagtaccaccatgccagggaacccagcctgcaaccctgcctaatcagaggttatcacagagcccagccagcagctgtgcttgattatgcagcctagccaatggtctcactggactgtgaagcacaaccaggagccacacctgacttcatataacaggcagcagcccctcgtaactaaagaacccaatagcaaaatctgcttgctcatggtcactatcagctggtccatccagaatcttaggctagactaaatattgaaagtgtccatccccaccaaaggacatctacaaaggccaaaagaggaagccaattcatcaaacgtacagacatgaaggtaagtacacaaagattacaaaaaaaatcaaggaaatatacgccacaaaaagaaactaagagagaaagctccaacaatgaaccctaaaaatatgaggatctataaaatgactgacaattcagaatattccttctaagaagatcacggatgtattagtttgttcttgcattgctataaagccctgagagtggaatttataaaggaaaagaggtttaattggctcacagttcaacaggctgtacaggaagcatgatgctaccgtctgttcagcttctagaggggcctcaggaaacttacaatcatggcagaaggcaaagggggaacaggtgcatcacatggctagagtaggagcaagagagagtgagggcgaaggtgccacacacgtttaacaaccggatctcatgagaacaccctcacttccacgagaacagcaccaaggggatgatgctaaatcattcaggagaacccgcccccatgattcaatcacctcccgccaggcccagactccaaaactgggaattacaatctgaaatgaaatttggtttgggacacagatctacaccgtatcaatagaattataagaaaatatggatagaaaagtaaataaaacttggaaaacaatatgcagacaaaagaattagtttgacaaaggaacggaaattatttttaaaaatagaaatcctagagataaagaatacaataactaaactgaaaaattttattaaaagcttgaacatcagactcaaacaaatagaagaaagaatcagtgagttcaaagacaggacatttaaaattattgagtcacaggagcaaaaagtaaaaagaataaagaaggcttatgaaaattatgggacaccatcaagagacctaactttcacataataggagatccaaaggagaagagagagagaaatgccccccaaaaaagcatatttaagaaaataatggctgaaagcttcccaaatctagaaaaacatgtcaatatccagggacagaagattcagaggttacaatcgaattcaacccaaagacagttcacgaagacacatcataatcaattatcaaaaatcaaaaacaaagaaagaattctgaaaaccaaaagacagaagatacatatcacatacaagggagttgtaacatggctatcagcagatttctcagcagaaaccctgcatgccaggagacagtgggaagatatatactcaaagtactgaaggaaaaaagctgtcaatcaagaatactctacctggcaaagttatccttcagaaataagagagaagtaaaatcttcccgcacctccatcttcccccgaaaatgagggaggtcatcaccatgagtcttgccttacaggaattatgaaaaggagttatttaagctgagaaacagtcactttcatatgctaataacataaaacatatgaaagtaaaaaactcaatggtataagtaatacatagtcatactcagaagactttagtgctgtaagtatggtgtgtaaagcaattttatctctagtatgatgcttaaaaaacaaaacttttaaaagcaactataactgcaataaactgttaagggaggccaggtgtggtgactcatgtctgtaatcccagcactttgggaggctgaggtgggcagaccacttgagctcaggagttcaagaccagcctgggcaacatagtaagaccccatctctactaaaaatacaaaagttacatgggcacagttgtgtgtgcctgtagtccccgctactcgggaggctgaggcacgagaactgcttgaacctgggaggcggaggttgcaatgagctgagattacaccactgcactacagcctgggtgacagaccaagactctgtctcaaaaaaaaaaattgttaaaggatacaaattataaaaagctgtaaattgtgaaatcaaaaacataaaattaagggagaataaaagtgtacagtttttatatgcaataaagttattatcatcttgaagtagcctgttataagtagaagatgttttatgtaagttgcatggtaaccacaaagtaaaaacctatagtagttgcacaaaacataaaaagaaaggattcaaagcatatcactacagaaaatcatcaaactgcaaagaaagatagcaagtgaggaagaaaaaaagaacaaagaatctacaaaacaaccagaaaataaattacaaaatggaagtactgaatccttacctatcaataattactttgaatataaatgaactaaattctccaatcaaaagacataaagtaactggataaataaacaaaactcaactacatgtttcctacaagagactcatgtcatgtttatggacacaaatagactaaaagcgaagggatagaaaagatatttcatgcaaatagaaatgaaaagagagcaagggtagatatatttaaattggataaaatagagtacattagtccattctcacactgctatcaagacatacatgagactgggcaatttatgaaggaaagacatttaattgactcacagttcagcatggctgcggaggcctcaggaaatttacaatcatggtagatggcaaaggggaagaaagacacctccttcacagggcaacaggacagagtgagtacaagcaagggaaatgccagatgtttataaaaccatcagctctcatgagactcacccactatcaagagaactgcatgggggaaaccacctccatgatccaattacctctacctggtcccacacttcatacgtggggattatggggattacaatttgaggtgagatttggatggggacacagagccaaaccatatcatagaatttaagtcaaaactgtaaaatgagaaacagaaggtcatcatatagtgataaggggctccactcatcaaacggatataacaattacaaacatatacatacccaatataacagcacctaaatatataaagcaaatattcatagatatgaaggaagagatagactgtaatacaataacaggagagaacttcagtactacactctcaacagtagacagatcatccacatagaacatcaataaggaaacatcagacttaaactacactttagagcaaatgtacctaaaagacattatgctcagcattccatccagcagcaagagaatacacttatgtctcaagtacaacatgaaacattctgcagaactatgttaggctacaaaacaagtcttaacaaatttaagaggatttaaataatataaagtgtctttttcaatcacaatggtatgaaattaaaaatcaattaacaggagaaaccttggaaaattcacaaatatgtgaaaataacataatcctgaacaaccagtaagtcaaaaaaatcaaaagaaaaattaaaaaaaaacttgagacaaacaaaaacgggacacaggatgccaaaacttatgggatatagcaaaaggagtcctacaagggaaattaatggcatttttttaaaaaaagaaagacaaacctcaaatcaacaacctaatattatacctcagaactaaaaaaaaggaaaaatgaactaagcctaaagttaggagaaggaaggaagtcataaagatcagagcagaaaaaaatgaaatagagactagaaaaacaataaaaaagatcaatgaaactacgagttggtttttcaaaaaaataaaatttactaaacattagcttgactaagaataaaagagaagactcaaataaataatatcagaaatgaaagggcagactttaaaatcgataatatagaaacacaaaaacaagggagaattacgaaccactatacatcaacaaattgtatagctgaggaaacagatgaattcctacacatatagaacctaccacgactgagtcatgaagaaatagaacatctgaacagaccagcaatgactaaggagactgaatcattagcaagaaacttctcaacaaagagaagctcaggacatgatgaaaaagagaagcttctcaacaaagagaagcttcagctcactgctgaattctaccaaacattagaagaactaatatcaatcctgctcaaactcttcccaaaaaactgaagtagagggaatatttccaaactcatatcataaggccaatgttaccctgataccaaaaacacacaaggacacaaggaaagaacattacaggccaatatccctaatgaacatagatgcaaaaatcttcaataaaatactagcaataaaaaaacaaaacccagaattcaacaacacattaaaatgatcagctaaccacgatcaagaggaatttatccctgggatgcaaaagtgtttcaacatatgcaaatcaataaatgttagacaacgcattaataaaatgaagaataaaaaccacatgattatctcaatagatgcagaaaaatcacttgccaaaattcaacatcatttcataataaaaactcttaacaaattaagtatagaaaaaaagtctctccgtctacctctccccctccccctccccctctccccacggtctccctctccctctctttccacggtctccctctgatgccgagccgaagctgtactgtactgccaccgtctcggctcactgcaacctccctgcctgattctcctgcctcagcctgccgagtgcctgcgattgcaggcgcacgtcaccacgcctgactggttttcgtatttttttggtggagatggggtttcgctgtgttggccgggctggtctccagctcctcaccgcgagtgatccgccagcctcggcctcccgaggtgccaggattgcagacagagtctcgttcactcagtgctcaatggtgcccaggctggagtgcagtggcatgatctcggctcgctgcaacctctacctcccagctgcctgccttggcctcccaaagtgccgagattgcagcctctgcccggccgccaccccgtctgggaagtgaggagcgtctctgcctggctgcccagtctggaaagtgaggagcatctctgcccggccgccatcccatctaggaagtgaggagcgcctcttcccggccgccatcccatctaggaagtgaggagcgtctctgcccggctgcccatcgtctgagatgtggggagcgcctctgccccaccgccccgtctgggaggtgaggagcgtctctgcccggccgccccgtctgagaagtgaggagaccctctgcctggcaaccgccccgtctgagaagtgaggagcccctctgcccggccagccgccccgtccgggagggaggtggggggggtcagccccccacccggccagccgccccgtccgggagggaggtgggggggtcagccccccgcccggccagccgccctgtccgggaggtgaggggcgcctctgcccggccgcccctactgggaagtgaggagccccccgcccggccagccgcccagtctgggaggggggtgggggcgtcagccccccagcccagccagccgccccgtctgggaggggggtggggggggtcagccccccgcccggccagccgccccgtccgggaggtgaggggcgcctctgcccggccgcccctactgggaagtgaggagcccctctgcccggccaccaccccatctgggaggtgtgcccagcggctcattgagaacgggccatgatgacagtggcagttttgtggaatagaaaggggggaaaggtggggaaaagattgagaaatcggatggttgccgtgtctgtgtagaaagaagtagacatgggagacttttcattttgttctgtactaagaaaaattattctgccttgggatcctgttgatctgtgaccttacccccaaccctgtgctctctgaaacatgtgctgtgtccactcagggttaaatggattaagggcggggcaagatgtgctttgttaaacagatgcttgaaggcagcatgctccctaagagtcatcaccactccctaatctcaagtacccagggacacaaacactgcgaaagcccgcagggtcctctgcctaggaaaaccagagacctttgttcacttgtttatctgctgaccttccctccactattgtcctatgaccctgccaaatccccctctgggagaaacacccaagaatgatcaataaaaaaaaaaaaaaaaaagaaagaaaaaaaaataccataacataataatcaacatgtatgacaagcccacaggtaaaatcctactcaatggtgaaaagctgaaagctcttcttctaagatttggaattagacaaggatgtccacacttattttcaacatactagtagaagtcctagccagagtaatttggcaagataatggggaaaaaaggcatcctagtaggaaaggaagaagtagaattgtctctgtatgctgatgacataaactatatacagaaaaccctaaggattccacacacacacacaaaaactgaattgataaatgaattcagcagagttgaataaaatcaacattcaaaaatcatctgtgtttctatacaatagtaacaaacgattcaaaaaagatttttttttttgagacaaagtcttgctctgttgcccaggctggagtgcaatggcaagatctcggctcactgcaacctccgcctcccaggttcaagcaattctcctgcctcagcctcctgagtagctgggattacaggtgctcgccaccatgcccaactaattgttgtattttttgtagagatggggtttgaccatgttggtcaggctggtctggaactcctgacctcagatgattcacctgcctcagcctcccaaagtgttgggattatagatgtgagctagcactcccagcccaaaaaagaaatttttaagaatctcatttataatagcaataaaaataaaataattagtattcatttattcaaagaggcaaaagatgtatacattgaaaactataaaacaccaatgaaaaaaattaaggaaaacacgggtagaaacatatcctgtgttctcggatcagaagaattaatagtgttaaaatgcccatactacccaaagcaatctacagattcaagcaattcctatcaaaatgccaatgtcatttctcacagaaatagaaaaaccaatccgaaaattggtatggaatcatagaagactccaaatagccaaagcaatcttgaacaataagtaacaacaacaaagctggaggcatcacactacctgacatcaaaatataataaaaaactacattaatcaaaacagcatggtataggcacaagagctgatacattagccagaggaacaggatagagttcagaaataaacatccatttatagacaattgatttcaataaaggtgccaaaatcacacaataggagaaaggatggtctcttcaataaatggtactgagaaaagtggctattcacatacagaaaaaaatgaaattgggtttttatcatacaccatatacaaaaatatactcaaaatggattaaagacttaaatataaaagttgaagctctaaaactagtagaaaatacagggagaaagcttcctgacatcagtcttagcaaagatttcttggatatgacaataaaagcacaggcaacgaaggcaaacacagacaaatggaattacatcaaactaaaatgtttctgcacaggaaactaaacaatcaacaaagtaaaaaaacaacctacagaatgaaagaaaatatctgcaaaccatacatattataagggattgatattcaaaatatataaagaacacaaataactcaatagcaagaaaaataaactgattaaaaaacaggcaaaggacctaaccagatatttctcaaaataagacataaaaatgccccacaagctgatggaacaaaatgctcaacatcactaattagggaaatgccagttcaaactacaatgagatatcacttcacaactgttagaacagtttttatcaaaaagatgaaagtgaacaagtgctgctgaggatgtggagaaaagggaacccttgtacactgctggtgaggatgtaaattagtataaccactacagaaaatgtatagaatttcctcaaaaaactaaaaatagaactaccattttttcatccagcagtcccactactcagcataaatcaaaggaattgaaatcaaaatttcaaagagatatatacactcccatgttcattgcagcattattcacaatagacaagatatggaatcaacctatgtatccattgaaggataaagggataaagaaaatgtggcatgtatatatcttggaatactattcagcctttaaaaataaggaaattctgtcatttgtgataacatggataaacctggaggacattgtgttaagttaaataagccaagcacagaaagacaaaatggcatgatctcacttacaggtagaatctaaaaaagttgaactcagaagtagagagtacaatggtagttaggaaaggctgggcgagagtaggaaaagggaattgggagatactgttcaaagggtacaaagtttcacttagacaagaagaatactttctagtgatcaactgcagagcatagcgactatagttaataatatatatttcaaaattggtaagagagtatatttcaaatagtcaccacaaaaaaccagtaaatgaggttatggctatgttaattagcttgttttaatcatctacattgtgtgcatgtgtgcattttgatatatgtatcaaaacatcacattgtatctcataaatatatacaattatgatttgtcaattaaaaatataaaaaattaaaattaaaattatttggggtcaaaaaaatctcttaaggatgaaatggtaagcaaaagtgacacaggaactaaacagaaggtaaatcaaggatggtaggcctgatatattcagcatttttaagacaaatctacatataaaattggtttttgtttcttttactttgggcaagttgaaatattaaaaataaataataaacattaaaatatttaaaatgttaaacatttaagtacttaaaatagaagaattttatgtactcaaagttggtaaaaatagattatcttctatctaaataatttaaaacacattaaaaggcttttgtatcaaaagattttaaaaaattcaaagtaaataacaactgatattataacaaaacaaaatgcatgttattttagatgatactgaccgaaaatgccagaccccattccattctcttttcacaatataacaaaaattcaaaaatcatcttacaaaacactttgtagaaaaacacagcgttctcagttgccatagatacacaacattctgcttcatcatgcaatattctgtattccattcaacttcaagtaaaaagaaatacataaaggaaacgtctttattgtgtaactcaggcttcaagagaacctaagattaaaacctagtggccaaaaaaggtacagaaaagggcttgagtacatttctgtggctgtttagtgttcaaagataataaagtgtgttaggtttttttttgttttgttttgttgttttttttttggagacagtgtcttgctctgtggcccaggctggagtacagtggcacaatctcaactcactgcaacctctgactcccagttaaagcgattcttctgcctcaagtcttccaagtagctgggattacagacaagtgtgagccaccacacctggcttgaagtgtattagattttcctgatatggtgcttcaaaaattacttgttggtatacgtaagagaaagcccacgtatccatagctttaacaaggggtccccaacccccagggccatggactggtactggtccttggcctgttaggaaccctgcatccagcaggaggtgagtggcagggtgagtgagcattaccacctaagctccacctcctgtcagatcagtgttggcattaggaagattctcacaggagcgtgaaccctattgtgaactgtgcatgcgagggatctaggttgtacactccttaagagaatctaatgcctgatgatctcaggtggaacagtttcatccccaaaccatccttcaggtccatggaaaagctgtcttccagaaaactagtacctagtaccaaaaaggttgggtactgctggtttaaatagtataggtgcttatttttttttcccttatgttacaaaaagttcagaagtagtctgctacattggcagctcaaagatgtcagggcaactgcaattcagccttctcctagcagttgcaaaatggtttctgtagctttgcatatctggaaaaggaagggtaaagggtgaagggtaaagactgaagggcaaagggtaagtatcaggtgagttgaatccccttttagggggctttcctgcaagttcctgccgatagcaaattaattatcctatttgcatctcaacttacttgaactacattaaatgtccagctccatctacaaagtaagagtatagttttaaaactgtgtctcatgttgccctaagtaaaatcaaggttctattactaataaagtaggaatgtatattggatgagcatctggcagtctccatcagatacagtcataataaatcattactctttctccagtaaagtactattgtgttattatactctaagtaatttgacatatacaattcatattatacaattatgcaattatatataagtacacaattcaaaatatattttgttgtatttaatacatatttaaggtgtaagaaataattcttcaaatattttcatatgtagctagacagatacatagatatgaatagataggcttaaggtgtaagaaataatccttcaaatattttcatatgtagctagatagatacatagatatgaatagataggcaggctggcagatagacataaatggcagaaagataaacatttatttctgtgcctggctaaagaacaaattggaactagtgttctcaacaagaaaaatcaatgaccatgttaactgatgatatctgtagtgcatttgtgaaagacaatcatcagttgatataagaaagacaacatgtcttatatgtatgttagtgtgggtgaagaaaggtatgaaataggagaggtaggaaatgtagaaatatttctagacatttaactacattactaacaccataaaagtttacctaaacaaaacaacaagcctaacatatctatttgtctgaaaaggattttatttctccttcacttatgaagcttagttgcccgataagaaattctgggttggaaattcttttctttaagaatgttgaatattggccgccaatctcttctggcttgtagggtttctgctgagaggtctactgttagtctgatgagtttctctttgtaggtgacctggcctttctctcaggctgcccttaacattttttcccttcatttctaccttggaaaatctcatgattatgtgtcttggggttgatcttctcatggagtatcttactggggttctctgaatttcctgaatttgaatgttggcctatcttgttgtgttgggtaagttctcccggatgatatcctgaagtatgttttccaacttgattccattctccctgtctttttcaggtacaccaatcagtcataggtttggtctttttacataatctgatagttctcagaggtgttgttcatttattttcattcttttatctctaatcttttctgcctgtcttatttcagcaagatctaaattattttccctggtctacttaacttttgagacttgtcgttgcattgtgaagttctatgcagccataaaaagcaatgagatcatgtctttgcagggacatggatggagctggaagccattatcctcagcaaactaacacaggaacagaaaaccaaacactgcatgttctcacttgtaaataggagctgaacaaagagaacacatagacacagggaggggagagcatcaggataaatagctaatgcatgtgggtcttaataccttaagtgatgggttgaaaggtgcagtaaacccccatggcacatgtttacctatgtcacacctgcatgtcctacacatgtatcccagaattaaaatcaaatcaaattacattttttagaaatccattaatgaattaactattcttccctgctcaaagcactgccccttacttcattattctactacttttagataatcagctttcatatatcttaagaatcatatttctttattaataaaagaaaagcaataaagttaaatgggttattattacagttattttcatgaacatcataattgttgcagaatatcactaacattttggaaacacagttaaagaaattaaaactctattttttttttgtttttgtgttttggagaaagggtcttgctctgtcgctcaggctagagtgcagtgcggtggagtgaccatggctcactataacttcaaatggctgggctcaagtgatcatcttacctcaacctctggagtaactggtaccatagttacatgccattttgtccagataattttttaattttttgtcaagatagggggtctccttctgtttcccagactgactcctgggctcaagtgatcatctcacctcaaaagttctgggattataggtatgagtcaccacgcctggccaaaacactttcttacatattaaaataataaattccttttggacaagtattaacattctaaaaaacattttattgaaatataataaatctaaagaaaagggaacatggatgattttctcaaattgaatacctccatgtaactagcactcaggtcaataaattgtatctcagaagtcattacctctccatccaagaataacttgcattcactaattttgtttggttctgtttctaacataaatggattcatataataaaaactgtttgtgatctttgtggctgatttcgttcaactttacatctgtgaaattcaaacatgttattaggtagatttgtagactcttcattcacattgctgtatagtactccgttgtgtgactagaccacagtttacttatccatgttacttctgatggatttgggcattttccagtttttttactattataaatcatgctgctattaatattctagtacatgtctttttgtcaagtacatacatatttcagtagggcacatatgtaggtgcagaatagctgagaataaggcacgcatatatttagttttcttagatattgtcaaatagttttccaaaatggttgtacccatttatattcatattagtagtatacatcagtttcattgttccaccattcttgtaaacactttttattttctgtttcatttaaggcattccattggatgtgtaatagtatagcattgtggttttatttttgcattcccctgatgactaaagaaactaagcccctttttatttattttttttgagatgaagtctcgctcttgtcccccaggctggagtgtaatggtgcgatctcggctcactgcaacctctgcctcccaggttcaagtgattctcctccctcagcctcccgagtagctgggattacaggtgcctgccatcatacccggctaatttttgtatttttagtagagatggggtttcaccatgttggccaggctggtctcaaactcctgacctcaggtgatctgcctgcctcggcctcccaaagtgttgggattacaggcatgagccaccatgcccagccctaagcccctttttatatgttaattggccactatgaaatcaacttttgtgaaatatctgttcaagtattttacccatttgtccatttgaagtcagcccttattgattcacagttctttatctattctggatatgagtcttttgttcaacacatgaatttcaattatcttccccaacctggagtgccctttcacctttgtactggtctcttttgatgaatagaagttcttaatttcaatgaagcccaattttaaaatattttgttttttatgcctttttgtttcctatttagaaaatctttatctattcccaactatcaaaaatgttcctacatcttcgtttgaaaatttaatcgttttacccttcatttgtatatttacaatccttttggagttaatttcataaatggggtaaaataaggggcaagattctttttccccccatatgactatctacttgatactgcaccatttattgaattggtcatttttttccccattgcactgctctagctccttttgacatgaatcagactgatcatataggtgtgggtgtttttggtctctttcttctgttccactggtcatcttgtgccaatatcacactctattaattaccatggtttaacagtatcctcaatatctgataacataagttctccaattgcattcttcttcaagattgccttcactttgcatttcatgtacatcttgaaatcagcttcagagtccccctctgttcccctaaaatggcactgttaagattttgattttttaaaattttttttatttttaagattttgatttttataattatggtgattctatagatttaagaactgccatttttataacatggagacttcaaatccatacacatgatatatccctcagcttattcaggtcttctttagtttctctcaacaacactttctagtttcagaacagagaccttgtgcatcttttgttagatttattcttgggtaagtgatgctttttgatattactataaatggcatcttcttcaagttttattttgtatttgtgctggtaggtacgaataaaatgtatttgtaaaatgtatttgtatatttgtatacaaaatttacttgtatatttatttatatttagtgacctaagttcattaccaataacattttaacaagcaaacattttaagaaactcatagtcacacaaagatgtcacaatgcagatatgtgcataactcattgggctaccttagatgactctcctccgtgctctcttaatgacctgtgaactccactagttacaccttctattataatcatacacctttatgcattggtctatcacacaagccacaaacatgcctataaataagctgtgtattcccagaatctacaacagtagctagtagagagcaggtattcataaattttttatgaataaatgaaagaaaaaatcccgtctgttgaatcctttgactggccagtaagtcaataaaacagtccctgtattaaaaaataacaatgttactattttcacaaatcagccaagtggagacataatgacatgttttctagcctgatattctcagtagatgattattttgcttattttctttctgcaaaagagattagtcactgatgaatattagtaggaaaaagcttcacttactatccaattaagcacttaaagatacaagttttcttttaagtgttttgtttattttttgtttttcaaagccaaatacttatacatattctttggaagctgtcatttagaattcattaattatcattatagcatctatttaaacgtttaaaggtattctaaaattttatctctgctacctaatcttaaagacaatatttaatagagacatttctacattatcatcaataattaaccaagagaaaatgcttctatttatattgggtctcttattatcataaaagtagtcttaaaaggctgatttaaaattacatgagctaatacaagcctaaaaggacaatgagacaaaggtccaagtcataatgaatggtttgtatgatgactggttttgttctttaagtctatttcttatccaatgacacataatgacacaaacatatccagatagtgttcttgcttccttgtaagttgagaattcctttcattaattcaataacaataataggatgatacactaaaacttaaaaatctctaagaatgcaaggaactgactagccagtttcaattgtgctacaaaccaggataaacctcactcgtcaacaccagcgcttttcagaactttgttttcatgacaaaccagtgggttttccaggtataaagttagcatcatatatctaatgactgttaaaaagaaaaggagtagaatttaaagccagatatttagcagcaaatagcatttaataaggatgtattttcaagaggagaaaaataaattaggaaagtcaagtggctagcggaagccccaggaggaactagttagctgacgttcatattgctggtatacaagatttaaaagatttactttaatagaattgctgccaatacttcagagaacatagctgtctttttcagtcatttatgtgtttcacagagaataggtaaatatagaacgctgtttctttgaaaaatatgattttatatatatatatatacatacatagaaataattctaacgataatgcattttcacaattaaaatatgtacattttacacagttagttgctgagagctaaactgataataaatttcaccatttcagtataaattagattatttaagcaatattaaatgagataaatgttcttcaaagcgaaagaaagagtgtgcagcaattttttaaaaagtttaagtctgttacattttgtctcatgggctttatttttgaaacagcaattctctttctaaaacaaactcaaagcttttattttttaattcaaaatcccactgtctgcaatctgcagcagtttccaaatggaaaaagatgccctacagctctgctggcttttaaacaaaatatttctgtaagaagagaaaagcggttcaaaacaagaacagaaaaggaagacttaaaaatatagactatggaaaaatctaaacacattatgattatccaaataatgactgctgattgatttcttttagaatttgagttatatcagattcacatttttttaatcaactgataatctgtaatcaaagacacaatttaccatgtttgacatatatattttaatattttaacatctgttcaaatttgccatgtaagaattacttgatttgcgaataagcctagctataaggattatgttctaaatggggtcccttgttactacactcacaccaaaggtgctttctttatttcagaaacccaactgcacttggcaaaactacatataattgaaaccagtgaagaatatttcttcaacagaagacaaccaaaataatttcctgttcatgggttgctgttactattagttttcgaggagtccgaatctagcacactagacagacagatcaggcctggtgagggctgctcagaaagatgggacataggaatcaggtatgtggggggaatttgaggggatcctagaggcatgcgccaaattgggttcttcgctggatcatttaaccagtccacagcaatgtaataccaagaagacagaaacacatgaactcttagataaagaagaaggagactcaagtaggtctggcagaattgaagaagtaagatcgaatacagacgatgagccaggcattcaacaaaacagtcagagatgatatgaggagtggaccaattaaaagggtagttctggaaccaattccacaaataggatctttcattcctggctatccttatctggtaacatcctcattttgtctggatagggttcttaaggtttctgagattatattatctccggggctttcaattctcccacagaaatacaatattctttttttaacttaaaaaaattaatcatttctccattctctccaatttttggacatgtattttctaatttttcctcattaataaataacatcacaatacacatccatcagcacacatctcacacactgtattttttaaaaaatagccttagaagtagaatcaacaggtaaatggagacacagtgttaaaatgatccttcaaaaaggttatacaactttacatgcccagcagaaatgcatgtcactacctgttttcttaggccttcatgaatttctatctatgtgttaggtggaaaatagcttattgctgttttaattttttttaaactttactagtgaaaataaagatttcttactgtcaatttctaccaaaaattacattggaattttgaaagaaattgcattgaatttgtaggtcaattatcggagaattaccatcttgacaaaattgagctttctaatccataaacaaagaatagctctccacttacttagatctttttaacatttctcttaggaatattttgtttttaatgcttaagtcttcaatttattttatttgtttacttgtaaatattttattcttttcgacgttattatgaattaaatggctttcttaatttcattttcaaatatttcactgctagtatataaaagtgtgatttttacatattttatcctgcaagcttgtttaaatcatgtattagttctagtatatctttaatagattttgtgggattttcactatacaggatcataatatctgatacatttgtacttctttctttccattctggatacattactagtagtagtagtagtagtagtagtagtagtagtagtagtattttgccttgatgcactggctagaagttccaatacaatgttgaataaaagtggcaaaagcagacatctttgccttgttcttaggaggaaaagaattaaatcttccaacattaattttattagctgtggagttttcatagatgtcctttattaggttgagtaaatttgcttcgagtcctaatttgccaagaatttttaaaatcataaatggtgcttgaatttttcaaatgctttttcagcctttatcaagacaatcacgtgattttttcccttattctattaatatgatatgtaacattaattgatttcctaatgttaaaacaatcttggattcctgcgacaaatcccgcttggtcgtggtgtataattgtctgtatatgttgctagattccgttttccaaaatctcatgaagggcttttgtgactatgttcatgacaggtatcaatccatagtttactagtgaaatatttgtccagctttgatatcagagtaatactggcctcacagaattaactgagaagtattccttcttcctcaatattctgaaagagttttcaaagaattaaaattatttcttctttaaatagttgatgtaattcgccagtgaagccatttgtcttagacttttctttgtgagaatatttttaattggcaattaaatttcttattatatttcaattcagattttctattcttgggatagttttgatcatttgtatctctctagaaatttgtccatttatctatgttgtacaaattgttggtatacaaagtttttagtaatatcactttataatcctttcattttctagaaaatcaatagtggtatcctatcctttgactcctaactttggcaatttctaactcctcgtttttatggtttgtcaatcatgctaaagtttgtcaattttgttgatcttttcaaagaaccagtacttggcttcattaattttccatatttttatgtatttcaatcttagctttctgctctaatcttcccccgcccccccctttcttccacttgcttagaagcttgctttgcttttctttttctggtttcatcaggtgaagtttaggttactgatttgagaattttatttttggatataggtgtttaaagctataagtctttctctaagcactgcttttagctgcattccataaatcttgatatgccatatttttgtttccattcagcttaaaatattttctaatttcccttgtaataccttctttgacccattagttatttaaaagtgggttatttactttccaaatatgtgaggatttcccagattttcttttgttgtttacttctaatttattattgttgaggtcaaagaacacactttgtatttccatccttttaaatttgagacttgtcttgtatccaagcatatggctatcctggagaatgttccatgagtgcctgcagtcattgggtggggtgatttaaatcatcacccaagtctcagacttacccataagtggcataagtacaaacagatccaaaggagcacagcaaagactgtgaaacaactgaagctggaatccacccacagaagatgagacaagactttctcactgaaaagaactgggaattctaacaggactcagagaataaaaaacactcagtatatactcttctgcttgcatattctttcattcagcaggattttgagatccatccatgctgttgtatcaataattcattccttttcactgctgagtaatatttcattgtacataccacatttcatttatcctttcaccttctgaggaatattttggttgcccaagttttgagcttttatgaacaaatctgctgtcagtatttgtgcaatagtctttgtctagacatgtctttatttctctttggtaaatacataggaatggaatgactgacatatatggtcattgtgtatttaacattttaagaaaattggcagttttctaatgtggctatactattttatgtacccatcagcagtgtataagagcttcaattgcaccacaactttgtcagcacttggtattgtcagccagtctttatcatcttagtcattctaatgaacgtgtagtagcatctcattttggtttttaatttgcatttccttgatgaatgatgatgatattgagcatcttttcatgtggttattagtcatttgtatatcttcttttgtgaagtgcctgttcaaatcttttgcctgtttttaattggattgtctttttattattgagttctaagatttcttttacattttagatgcaagttcttcgaaatacatgtattgtaagccttgtcttccattttctggtttgccttgtttttgtttttttaatgatgtctttcaaagagcaaaagtttttagttttggtgaagtccaatgtagcaatcttaactgaaatttaatttctagtttaattgcattgtggtaagaaatatgtgttctcagacatgttaagttttagaaatatactgagggttcccttacagtctactaagtcttttaactgttttatgagaacagagatttaatatgtagtgtcaaatggtagaaagttgaaatacagattaagatggcagacaggaggcaggactagcttgcagctcctctccgatggccagagaagtgtatggagactcacatcgtgaactttggctccaagaactactacaggaacatagcaggaaagctgagagaatccacagaccctttgaaagaactggatcacatcactgctgcaggctccctgagacaacaaaacactgagagtctgcttgctttctcaatgggaggctcgtgatctggggcaagttctcaaccctgattgccagttgcctggaaatagactcggtgctgttggaaggacacagtgggagtcagacaggccttcaggactgagggctgtgtgggagcagggtgaggccttgactgctggctttcccctacttccctggtgacctgtatggctcactagaggcagccataatccccctggaaatataactccactcgactgggaaccacactcccatcccccgcagcagtaacagccagccccacacaaggagaggctgagctcagacatgcctattgctgcccccacctagtggtctttctctgcctaccctggtatcagaagacaaaaatcgtaatcttttgtgagctctatggccctgtccactgtctgagaaaactgaatacttaagccggtgtccctagggcaagtttgcatcctccctataggaccatagctgacgcactcttgaagtgccacctcccggctggaggccaaacaacacaaaaccagcgcactaaacaaaaacacaaccaagaaccctcacagagtccacttcactcccctgctatttccaccagagcaggtcctggtatccatggctacaagacgtaaagacagatcatatcacaggactctttgcagacactccccagtaccaacccacagcctggtagctccactgggtggctagacccagaaaaacaagaacaatcactatagctccgctcttaggaagcctcattcctaggggaagggggagcctcattccaaatcaccacatcaagggagcaccccataggacaaaagaatctgaacagcagcaaaccccagatcttccctctgacatagtctacccaaataagaaggaaccagaaaaaaaattctggtaatatgacaaaacaagattctttaactcctccaagagatcataccacctcaccagcaatggatccaagccaagatgaaatctctgaattgccagaaaaagaattcagaaggtcaattattaagcgaatcaaggaggcatcagagaaaggtgaggttcaacataaagaaatcaaaaacatgatacagaatacaaaagaagagttcttcagtgaaatagacagcatatataaaaaacaatcataatgtctggaaatcaaggacacactcagagaaatgcaaaatgcactggaaaatctcagtaatagaattgaacaagcagaagaaagaacctcagagctcaaagacaaggctttcaaattaacccaatccatcaaagatgaagaaaaaagatttttaagaaatgaacaaagcctcctagaagtttgggactaagttaaacatccaaacctaagaataattggtgttcctgaggaagatgagaaagctaaaagtttggaaaacatatttgagggaataatttaggaaaacttccccagccttgctaaaggcctagacatgcaaatacaagaagcacaaagaacacatgggaaattcatcacaaaaagatcatcgcctaggcacatagtcatcacgttatctaaagtcaagacaaaggaaagaatcttaagggctgtgagccaaaagtatcaggtagcctagaaaggtaaacctatcaaattaacagcagacttcttggcagaaaccctaaaagctggcaaggagtggggtcttatttttagtttccttaaacaaaacaattattagccaagaattttgtatccagcgaaagtaagctttataaatgaagaaaagacatagtcttttccagaaaacaaatgcggagagaattcgccaatacaaagccaccactaaatgaactgctaaaaggtgttctaaatcttcaaacaaatcctctaaatacaccaaagcataaatctcacaggacctatataacaataacataattaaaaaacagtaggtattcaggcaacaaatggcacgatgaatagaataatacctcacatctcaatactaacattgaatgtaaatggcctaaatgcaccacctaaaagatacagaatggcagaatcgataagaattcaccaaccaaatttctgctgtcatcagtagactcacctaacacataaggactcacataaacttacagtaaaggggtagaaaaagatattccatgtaaataaacaccaaaagcgagcaggagtagctattcttatatcagacaaaacaaactttaaagcaactgcagttaaagaagacaaacagggacattatataatggtaaaaggactagtccaacaggaaaatatcacaattctaaatatgaatgcacctaacactggagctcccaaatgtataaaacaattactactagacctaagaaatgagacaggtggcaatgcaataatagtgggggagtttaatactccactgacagcactacacaggtcatcaagacagaaagtcaacaagaacaatgaacttaaactataccctacaacaaatggacttaacagatatttacagaacattctacccaacaactgcagaatatacattctattcagaaggacatggaacattccccaagatagaccataacaggccacaaaacgagtctcagtaaatttaagaaaatcgaaattatatcaaatactggtgggaatgtaaagtagtacaaccactatggaaaacactgtagagattccttaaagaactaaaagtagatctaccatttgattcagcaatcccacttctaggtgtctacccagaggaaaagaagtcattatatgaaaaagatacttgcacatgcatgtttatagcagcacaatttgtaattgcaaaaatatggaaccagcccaaatgcccgtaagtcaacgagtggataaagaaattatgatatatatacatacatacatacacacacacacacacacacacacaccatggaatactacttggtcataagaaggaacaaaataatggcattcacatcaacctggatgttactggagaccattattctaaatcaatggaaaaccaaacatcgtatgttcttactcataagtgggagctaaggtatgaagacacaaacacataagaatgatacaataaactctggggactcagggggaagactttgggtgggggaggtgagggttaaaagactatacattgaatacagtatacaccgctagggtgatgggtgcaccaaaatctcagtaatcaccactaaagaaattattcatgtaaccaagcaccacctgtgccccaaaaacctattgaaataaaaaaataaaaaatttaaaaatatatacataaaaataaaaatgttaaacttgatcagctattccactcctaggtacagtagtccctccttatatgttctaagaccctcagtggatgtctgaactttggatagtaacaaaccctatatgcactatggtttttgctatatagctgcattgtatagggcaggtagggtatacagcatggatatgctggataaaaggatgagtcatgccttgggtaggacagagcaggacggcatgagatttcatcatgttactaagaacagtgcacaatgtaaaccttatgaattctttatttctggaattttccatttaatatttttggactgtggttgatggaaggtaactgaaaccatggaaagtgaaactttggataaggtgggactactgtacttattggaataaaatggaaacatatatctacaaaagtaaacgtaaaaaaataaaacgctaaaaaagaaaaagtcaaaatatagctgtcatataatttgttagttacaccccatttggattttacccattgacctgtcagagatggagaaaaatatatgaaaacatcccatgactatctatgtccatttctccatgtgttcctaacatcttttcatatttcgattgagtactcttgcctttagcatgcaaaaatatatccctttgtccagtttattgacttgtattgatttaatttgtatgatagtgttacaatcctactttcctttttttctgaatataagtgatatattttcatcatccatttattctaacttttgtgttaactttattttagttattagttttataaatagtatatttatggatttcagtcttctaatcaataccattttactagaaaaatttaacctattaatgtttattattacaattatatactctatcttattttggacattttgttgtatttctgcttctgttcctttggcagcctctcctctcaagctttgctttttaacttttcaagacttttatgagaatgtacaacttgttaattttattaatgctcatatttaaacattacaaaattatttttacctacatttccctaattttaagaatcttatgagtctcacatatttatgacaaagagttttagtatattttgcttctccaactcttgctattcatctacttttgatccttgttaatgtaatctagggatacaaattcaagttgttaatacatttgtattttctgttttatataccttccttttcaaaaaatcaattaatattagaattctattcttaagtagatttgtaacaattatttaaatttgtttctacttctttggggttccaggtttctctactcatcctttcatatgatggtttccttatgtgtgggaagtcttatgcttcatttctggattggttcatgtattcatacaaattttttccagaaaaatgtggtatatattatatgagctcttatatataagaacatgctttcctattgtttttgtaagcaaaaaactccttggttgtgtataaaatggaatcaccacttttttttactgcatgcatattacatacatgtatattacacgcattacattatatgtaacatgaatggtgcagtttcagcctaccataccatagctgtggatccaggcatttctgtactcctgggggttggggaaggtccctgctgccctagctggctcagaagtgcttgctcctgctgtctggtttctccttgctgtccgtgcccactccaatgttggagcaaagttagggctgagcctgggtgctgtcgcatgccagccccctgctgcctcagccacctctggactttggctgccaatgagcataggagggaagccaagtgggtgctgatggcagctcaatgctggcctgcaggcaacccttgacacctacagcctgggcaccatgaacagcagcagggggcagacagactcctgctcataaggggatgggtccctagtgaggcctcaccttcaggccagggagggcctgaaggctgggaggcctggctgcaagtcccacagactggagtgggaactcgtggtgccttttctgggcctccccatggccacccatggaccaatcagtgtgcacttcctcccctctgaggcacataaaagccccaggctcagccagagaagagcagatgtggggacaaccagctgcagaggggagctaccaactccagggcctcctctctcctaagagctgcagatgtcaggacaaccagctgcagagaggagcaactcatcccagggcctactctctgctgagggctgcagagacatcgggaccaccagctgcagataggagcaacccactccatggcctcctctctactgagagctggggagatgagaggaggacctgcctacagagaggagtaacccactctagggcctcctctctgctgagagctgcagagatgatgggactacctgtctgcagagacgggtttaccactccagggtctcctctctgctaggagctgaacactcactgggacaccctggctgcagaaaggagctacccactatgtgtctctgagctgttctattgctcaatgaagctcctctttgtcttgcttaccctccacttgtctgcatacctcatttttcctagtcgcaggacaagaactcaggacctgtcgaatggcagggctaaaagagctgcaacaaaaacagggctgaaacatgctccttgctcgccttgttgaaggcaaagagaaggagagaagagctacagccccagacctgggcgctcccgagccagggctatgacttcctctttgggttcgtgtggttcttggctcctccttgggttcctgtggttcctggcatctccaagcttccaggtgccaccacattccccagtgacagttgtggaagctgcttgcagtatacctggtccagccacagcctcacagagagctgacacccatgctggcacctggagctgcccacccactgcagcaggtggcatacctgactgcacagcggccagaccccatgcttgctcacataccccttgctgctccatgcctaactcacccttggcaggtgttggatacaggcagtagcctgagccaagagcagcgtatcaggctgagtgggtggaatgagcccagtgggccttagcaaaactcaggcaaaggtgccactagccacagaggtttctggccaaaaaagtgacaccctagggatcccgtaacacagggctcaatcctcagtcagattcaaacatgaaaccttccttaggcacatttctcccacccagtgtgtgcttgggactcctaaggaagataactatagtgtaaaataataagtgagtattgaaacattctttataatcaggaaaaactgaaaaaaactaaatatgcttgagtaggggagctgataaaatatactatattcatatgataaaataaatttagtgttaaaaagattgtactaaaacagcatggttagcacacagatacataatattagatataaaagggcaaacagaaatagtacttaaaatctgttcatatttatataatttttaaaaaaacaaaaaaacatttatgcctgtaacatattaatgcataaataatatatacatacatattatctatgggcattatgtatgcatataaaataaactgaaataatgcagccatctccagtatccatgggtgattggttccagaaccccctccagataccaaaatccacagacagtcaagttcctcatataaaatggtctagtacttccatacaacctgggcacatcctcctgtgtactttatcattgctagattacttctaatacctaatacaacatctacatgtcacttctatcacatggattcaacacagtcctctgcacatggcaaattcaagttttactttttggagcattgtcaaatttttccaaatattttcgatccatggttggttgaatctgtggaggcagaacccacagatacaaaaacacatggatacagagggctgactgtatacactcaattaattataatggatttctccagggaagaaagaataatgtgattagacatgaaaacaaagtaaactaaaacttcacctgaattttttagtttatataaaccacgttaacaattattgcatctttgcgatgggtacccaggtgtttgtaataattccctttattcttttacaaattttgtattttctttaaaaactaaaaaaaaaaaaactacccatcttatataagaattggagacagcctttgttcttcacaactgccagttgaaaataatttgctgtagctgatcaataagacactatttatagaacatgaagaaacacagacatggttaactggagcccctgctctaaagaaactgatcagtcatgggatttttctcttaggattatctatccttccaaagcaaggtacatgcttgccattactacatttatacaggggacttttaaatgatcattctggcattgcttgaaggatgaatcaagtggtaacatctctttctcattctgaatctctgacccgattgtatggctaattttgatacagctcttttaaaaagtgaaatgtttctgtcatatttaagatgagaatgtaccttcctactgagagagtgactttcaaaagggatggtgtggcagcctccttacctgctctttcatttcagcatagactttctctgagttcagttccacctgccgcttaaactcttccagagcggcatctgcctgctgggcctgcaacctctgaacttcagtcacacgagttagctgctcctctttttccctagaaaggttcagagaagcttcagagttaaaatataaaagagctaggcctgaatgaaagaacaatatttaaccccctctaaaataaaatccagattttaatttttttgatccaaatcctacaaaacttccctttagaaatttgacaataaactaatttgtctcaagagaaaaagggtataaacatatattgtgtattctgatgaaggcaaaactgctttcaaagatttctctaaaaacaaaactgagtaaaaccatgtgtctccatcaagtgatgaatgaataaacaaaatgtggaatagctatccaatgggatattagtcattcttaaaaaggaatgaagttctgatacctgctacaacatggatgaaccttaaaaacattcagctaagtgaaagaagccagtcacaaaaagttacatattgtatgattccatttatatgaaatttccagaataggtaaatccatggagacagaaagtaccttagtagttgctagggtctgagaggctggggaaatagggagtgattgccaagggatatgaaatgaggaaaatatgaaaatgttctggaattagatagtggtgatggttgcacatccttgtgaatatactaatatccaccaaactatacacttcaaaggagtgaattttatggtatgtgaattatatctcatgttttttttttaaaacaatgtacaaatagaaagatgtatgtctaccagaagttaatctgcagtgaagtcaatgcaacagagaaacatgatggcctaaaattattttactgccttctagcagattgcctaaaagaactgataaccatctcatttcttcataccttaggcggaaactatatagctgaaagggtccaacaaaacaaaaggaatctttgcatgttgatagaagaaaaaattaaagccttcagtttataaatgcatgccatttaacaatagttaactttgaattctaactaggcgctgggtattgtgcaatggaattttatatggtttggctctgtgtccccacccacatctaatcttgtagctcccataattcccacgtgttgtgggagggacccagtgggagataactgaatcatgggggcaggtctttcccatgctgttctcatgatagtgagtctaatgagatctgatggttttaacaagaggagttcccctgcacaagctctctttttgcctgccgccatccatgtaagatgtgacttgctcctccttgccttccgccatgattgtgaggcctccccagccacgtggaactgtaagtccattaaacctcttttgaaaattgccaagtctccagtatgtctttatcagcagtgtgaaaatggactaatacagaagtttatgtcttctctcatttattctcacagtaaaccagtataagagtgttattacatccttacttacacagaacaggaaactagggcttagagaatacttccaaggttacacacctagagtaacaacaggtcaagccaggattccagtcctgaaagtgtgcttctagagttcctgttgttggctgctatgccacactgctttcctgatcttccagatgccacaggtaagattaacttagctcaccttccctaaatgggaaagcttacacaagtgaaaaatatgttcttactattagctgtaacactgaaggatgctgggcgggggtgggtaatttaactcactcaaaccaaattttagagaaatatcataaaggggagaaaagacatttctaaaacaagatgatgcaatcttttaagacttgggcaaaaagtaatacgagtttttccaggttactcatctgagtttaaaatccactctaagacacaaaaatttctaggcttttcaataagaacgtacatatcatatatcaaaataccaaactttctccctctcccccaccaaattgaaaacctctttcaaagcttaagtggtcaaaagactgataagaaaaaaagtgtcacctaatttctacttcagcaagactctcttgtccctttacaatgaggttatcaacaatatagatatatagatatcgatatagatatagatatagataggggtgtgtgtgtgtgtgtgtgtgtgtgtgtgttctctcctcgcacccatatcccatccccacccctgtatttgggatccgcaaacaggcacatttttgttgacaggctgaaagagcatatcgtgcatgtttatttgtcattttaaacaccaccttgtgtctatttatcttttcatatcccatgtatccatctacctgaaggtgacaataatcattgcaatcccatgataaacaaaacagtttttccactaaatccctgttcctttatgtgtctgttttacagatgtagccaccatttttatgacctacagagtttaatactgccccaaggtgtgtgatgccctgcatgacagttaagccattccaggtcatgaggcatgccacatgtggctctcagtaactgcattttgcagcaatggggtacaggattctggaagtttttaaaagctattcttcaacttgtctactttaatgaactgggacctgggtatcttgttgttcaccatgtttcttacatgttgttaaagcaaaatggtcttaatgttaactggctgttaagttctaaggtcctaacattagtgaggcttttttgccacctaatgtgaatattagctcaaagataatggtgattaataactgaatatcatactgaaggctgattttgggggcaccactatatgaaagactgagcactctgatggctataaagaattttaaattgttctggtgcattttcactctttctatattattctgttcaagaacaggaggctttaagttgtatgtaggatttccctgctacaaacattgaataatttgtttgaatataaaaatatctaaatactaaaacagcacatgggaacaacataaagtcatataaattgttattgggtaccatggtctagacctggcttggcaaatagatgctctctggtgtggtggtcccaattgactggaaggggctgcctggaatgtactatttaaaggattctgagagcaagctcagagggaaagggtgctgtggttgatgaaagggtgctgtggcactgtttacaaggcactggggttaggcagtgcaatgaccgtttagagattatagtgactagtttatgttcctctttaatttttgaggcccttctaaaagcacttgggaagaccattttataattaagattaacatttatcaaaggattacctttggtcagtttgtatataaatacaaaagaaagtatattgaacatgatttgaaaactttaaaagtttatatatcacttactttttaattatggaacattaaatagccaaaagaaagataacacattttataaaaatatatgacctatagctgaaatagcaactttgtcctatctatgttgaaagtcagttttttatattatttgtgcaataattcacatgaactatttaaacacttttcatttaataggatgaatctttttccctataacatgtcattcttacctactaagcttagttcatttactttataactaatttatgaccacataaatcaaagtcataaactttagctatccgtcagataattagaggccattttaaaatatgaaaaccttgcacaataaggcacattgttttcaattgatcatttctaccctgatttacaaatagcaaatattgttttatactcaattataagcacagggaaatatgtaaaatctggtttccagtcccgccatactgtctgaactaatctaatagtaacactaaatatcaaaagtggcctcattcaatgtaattcaatgttcttgtccagtaaaaccataatgaatacattgagctccactaatatttagaaaccttctgcccccttttttttttttttttttctttgagacagggtattgctctgtcgcccaggctggagtgcagtggcacaatcagggctcactgcagccttgaactcctggactcaggtgatcctcccacctcagcctctgggtagctgggaatataggtgcaagccaccacccctggctaatttttttcttttttgtagaaatggggttttgtcaagttgcccaggctggtctcaaactcctggactcaagcgatccaccccggtctcctaaagagctgggattacaggcataagccgctgcacctggcccctctgtcttaatataaattaaatctgtcaattcaaataaagaggtgataatcattttagggaaagatccattttaatttctacatggtaatgaagcagaaatgaaaatgctgaagctttgaaacaggcaaaggtctgctcctagcacaggaacagcgctcctttttaccatgatcccaatagtgcatcctgaaagaaggaggaaaaaaggactgaagattttttttttcccagtggaactagttgtggggccaagtagaaacgcatcactcaaatgccttaaagctgggcctccatgaagataaaaaggtggaaagaaaatttgctttttagctctgatttattcataaagtgcagtaaattttcctcatctgagtatataaaggataaagaaaaaagaagctgcattgttaaacaaccacaagccagctcagattaaaggatgttctgaagtacatgattattccaaaaagggcaataaaatgtagggaactaatggatgacagtttagtatttttgagctttacaagctaacatgtatatgtacaggtgaaccttaatttgaaaatcttccttttgcacatttctgttccagtacatttgataaagatggctgcaacccaacatgtatgtataaggcttcacattacagtatacttcatttcctgccagcttggcatctcccctggaaactccaagaaaaacaacacaaaacaagaaacttcaaacaagtctgaaaaacagctagaagagtccccatgccctttccagctgggctggaaaacaagactcacaagcggcaatatcacctatattcatggctgctggttgttacttaaactgattaaattgaatgactcaaaaatatttaaaataacaactttcataagcatgacagatgaataaactgctttggcctcttcttcacttgacttctaaaactagtagtctctgctaaattctagtttaaaaatggtaaaccctgtagacagctaaacatttgatacttcaacagtcagaaagaaatgcccagtaaaatgaaaattagtattggtcttaatattgaatatatggtaatacttcccaaattgatctacagattcaacataatcaatgcatgcagggccacaagccaaggaactggggcagtgtctagaagatggaaaaggcaaggaatggattattctcataagctcaatgaaactatgatgatccaaaacactaaatcagaaattattctctcgctactaagggaaaagcttgaaacaggtacgataatagcataaagaagttctacagaactctattctgacaaagaccttttattgtcaacaatgtaggcttacccagagagcttgcccacagggtcaaacaccagtcttaaaaaaccatgcctgttggttgaagcatgttagttataaataggaatgaagaatcttcttaaacaattcaaaaacctcttaagaagatatggatgtcagctaggacgtctataaatctatgacgccaactggatttgaatcataattcaaaagaactagttctggcatcaactttgtagcctttattctcagtaagttagttttgttctgggagcagaaacaagggtgctggcagcaaattctaagatctgctcattcaaatactatagaaaacataaaagaagtgtaaaacatggttcctatcttgcaaaaactataatctgactaagggaaaagatgaaaatataaggagaaaaataaaatgatgcaatatcgtacacattaaatcttgtgacaaattttaagtgctaaaagaatacaaagaacgtaacaatgaagtaagaggctatataagaaacaattctcagaggatcaaatttatgtgtaagataggaaataaaggtatataagtaaaattaatgaaagttttaaacagtttaaagtttatgtaataattttatgctaaactaacttctgcctgtaatatgggtccataaataaaacaaactctagctcagcaaatacaaaagcaagtaatacttctatggtaaactaacaaaatattgagaaaattatccttaaagataaagcagtcatggtttatggtgaagaaaaattcctttaaaatctttaaattctttaaacttcaaaataaatcccacatatgatgctattttcgtttatgtccctatatttaacaaatgattaaaacttccatttataaattgtacaccatatatgcagagtttacatacaaactcactaatgtatttcattacagatgtagtattatatcagtatataataaggaaattacgttattcttgtaaaatgacaaaacctaaatattctggaataggtgaggaccacttcttgttattaggagaggaagaaagacagtatgaagtcactcaagcagaatgataagtaaaccaaagccagatcaaaggaataaagaaaaaaggctgaaatgtgaatctgaaatatttatttccttcaaaaacattatccatgccttgtcccagggcagttcaatatttcaaagtaactggaaaatattctcacttacattcatcactatgcacaaatagatcaaatttcaagcaggcaaattttctatttatcaaatataaatgtaatatttatcatgtgacagaagcttttctgctcattatagatgatttctaagtgatatgaaatgaaaagtcgcaatagatatgtcccactacttttagagaattgtattgctacaaaatataacatttatagtgtagccataatttttaaatctttggaaatgatgaagcagagtgaacatttgaatgtctaccctgctcatcacagttagggcagttcacatattatttgacgttatttctattagaaaagttactacattttttagatgaaaacactgaaacttagaatagttaagtgatttgctcaagttcacataaaagtgccagaacaagcgatgaaaacaacccatctgactggaagtccaaaatagtttcgctacatgtaacattatttctttaaatctgtacatacattttttattaacttaccatttcatattaattagctgaatttataataagtacttatcgtaatttatccttacatagcaatatttgtatatcaaatatctagagtatttgaaagctaaaatgttcattagcatttacttaacatctatcacatgccaagatctgtgctcagtattagaactgcaaaaatgattaagacattatatcagttttttgtttttttgtgtgtgtggatttttttttttttttttgagacaatgtcttgatctgtcaccccagctagagtgcagtggtgcgatctcggctaactacaacctctgcctcctgggttcaagtgattctcttgcctcagcctcccaagtagctgggattacaggcatgcagtaccacgcctgactagttttttttgtatttttagtaaacatggggttttgccatgttggccaggctgatctaggaaaacattgtaaaggacttctcattttgttaagatcattatgaaaaatatttaagattaacgtattacatgtacattgcataatacataccacatgcatatcacatacaagcatattacatgtacattacatgcatacacatcacacatgtatcacatgcatgtgtaatgcatgcatattacacacaggtatactgtatttgcattacttgcatgtatattgcatgtatgttacttaaatgaatattgtgtgcatgtatattacacacaagtatacacatatattgcatgcacgaatattacatgtgtgccgcatgcactgcacacatattgcaagcatatatgacatgtataacactgcatattgcatgcatgtgtattgtatgcatattacacgcatacaggaatatcacataaatgtgtattgcatgcatacactacacgaatgcttattacatgtaaatcacatagatgcatattacatgcatgcgcatcacatgtatattacctgcatacatattacaagcatatcatctatatatagcatgcatgcaaattacatgtgcattatgtgtaaattacatgcatgcttaacacatgcatattacatgcatatcacatgcgctacaggcatgcatatcacaggtatattaaatgtatgtataacatgcatatcacacgcatgttacacacatatcacatgtgtattgcgaacatgcacgccacatgcatattgcatgcatgccacatcacatgtgtattgcaaacatgcatgccacctgcatattacatgtatgcatagcacatgcatatcgcatgtatattgcatttatgtattttgcatgtgtatagcaaacatgcatattacatttgtattacatgcatatatgctgcatgcatgtcatgcatgcatataccatgcatatatgcatgtatattacatgcatgttgcacacatattacatgcatgtatgtagcatggatgtcatactgcatgtgtatctcatatgtaaaacatattgcatgcatattacatgcatgtgcactatgtgcctatattacatgcacacatcatgcatatatattacatgcatgcacacatcatgcatgtatattacatgcatgcacacatcatgcatgtatattacatgcatgcacacatgcatgtatattacatgcatgcacactacatgcatattatatgcatgcatattaaatacatgtataacacatgaatattacatgaaagttacctacatcttacatgcaaattgcgtgcattttatatattacctgtatattgcaggcatatggaatggaagcatattacatgcatgcacgcatgtatattacatacatgcatattacacgcatatcacacacatgcatattacatgcatacacatgacatgtgcctttatcacatgcatgtgttaatacatgcacattacaggtatgttacatgttacatgcatgcataaaatgtatattgcacatgtgtatggcgcatgtatattgcatgcatgcacattacatgcatatgtcatgtatatctgcatgctgcatcgcattacatgcatatcacatctgtgtgcattgcatgtatgttgcatgtatgcagttattgcacccatattatattacatacctattacatgttggccaggctgattttaaaaaactttgtaaagggcttcttattttggaagataattattggaaatttttaagaggcttgtattacatgtctattacatacatgcatgtcacatgtcttacatgtatattacatggtacattgcatgttccttgcgtgtatgagatttatattgcatgtgcacatgatacatgtacattacatgtacagcacatgtacagcacatgcatatcacattgcacgtatgtatatcacatgtatattacatacgtgcaaaacatgcacatcaaatgcgtactgcacacatgtacagcacatgcacataacaaatatgcacgttacatgtgttttacaagtcttaaaaatatattacatgtatatgtatttcaggaacacatgtatatcgcatgtatgtacattgcatgtatatagcatgtatattgcacccatgcagcatgctgcatgcatgttacatggatgccgcatgcatgcatatcacacacatgtatcatgcatgtatgacatgaatgtcatacatatcacacatgcacattacatgtgtatcacctaaatgtatgttgcatgtatgttacatgtgtgttgtatgtatatggcatgtatattacatgcatgcatattgtgtgcatattatatgtatatcccatgcatattgcgttatattgcatgcatgtcacatgcatgtatgttacatgcatattacatgcgtgtatattacatgcatattacatgcatgcataaatatattgcaggtatattgctctaacaacactaatcaaaagaaagctggagtcgtgatattaataccagacaaagcctattccagggcaaagaattttgccaacactaaagaaagtaaatttacagtacttaaagagccatatcaacaggaaacaaatgctgaaaataaaagaagcaaagacttattgaaatgcaggggtgaataaacacatgcacaattacatttcgagatttcaatatccctctctatcaataattgataggacaagtagacagacaagaataaagagctaggataactaggatttgaagaacactatcaagcagctaggcctaatggacacttatggactattccacccaatcaaagaagaatacacattcatttcaagagtacatggaacattatcaacatagactattctggaacataaaacaagtctccataaatttaaaaggattcacatcatgcaatgcatattttgtgatcattgtgaaattaaaaatcaataaaagaaagatatctgggaaatccccaaatatttggaaactaaataatgtttttctacacagcccatggaccaaagaaaaaataaaatgagaaattagaaagcattttggattaatgaaactgaaaacaaatatcaaaattagagagatgctgctaacaatgtacttgaaggaaactttatagaattaaacatttgtattagaaaataatatacaggtttcaaaacaatggcattagctttcactttaaagaacagtaaaacacaaaataagtagaagaaaggaaataataaaaatcaaaacagagatcaataaaatgggaacagaagaacattaggcaaaaatcagtgaatcccaaagctggttctttgagaagatcaataaaattgataaacctctagctaggctggtcagaaaaaaagaaacaatacaaattatcaatattacaaatgagagtggttatgtcactacagattttatatgtgttaaaaggacaagaaaccagtatcataaaagaagagaaaaaataatttttgttttgttttttgttttttgagacggagtctcactcttgcccaggctggagcacagtggtgtgatctcagctcactgcaacctccacctccttggttcaagtgattctcatgcctcagcctcccgagtagctgggattacaggcacctgccaccacacccagctaatttttgtatttttagtagagacggggtttcaccatgttggccaggctgatctcgaactcctgacctcaggtgatctgcccgccttggcctccgaaagtcttggaattacaggcgtaagccactgctcccagcctgagaaaaaatttgaatccttacttcttcccagtatatacaaaattactaaaaagtgatcaaagtcctaatgtaaaacctaaaactataaaactttcagaagaaaacctttgtgaccttgggttagaaaaagatttcctagatatgacaccaacagcacaatttataaaagaacaaatactgtaaacacagtagacttcatcaaaattaaaaacacctgctttttgaaagaaaccattaaaagaatgaacaggcaagtcacagactgggagaaaatatgcaaaaacatctatctaataaaagactggtaagcagaatatatcatgaaatctcaaaacttaattataagaaaacagtcaacccaatttaaaaatggactaaagatttgaacactttccaaggtagataggcatatggccaataaggacatgaaaacctttttaacatcattagtcactaggaaaatgcaagtgaaaaccacaataagatactactacacacttgtgagcgtggtgaaaatttaaaacactgatgatatcaagttttgggaaagatgtggagggactggaaaaacgatacatactgtctgcttccatttatctaaaattctggaaattgaaatataaggacaggaaatcagtggttgcctggatatggggaggtggaaaggggtagaccagaaggatggcatgagagcaggagagaacaagagaacgtttggggtgatacatatgttcacacgtatatcttttttgaattggtagtttcatgagtatgtacatagttcaaaatatatgaaactgtatactttaaatatgtgaaatttattgtatgacaattctaactaaataagtgtgttaaaatggcccttaaatgtaataaaatgtttaatctcacttacaagagtactgcaaattaaaaccgtgtcattatttctcacctaccagatttacaaaaatgtttaaattgtaacaacattctacttgggagtctaaaaggcttcgctgttttcttacttctttttttttttaagacagggtctcactttgtcacccaagctggagtgcagtggtgagatcacaactcactgcagcctcagcctccccagctcaagcaatcctcccacttcaaccccccaagtggctgggactacaggcacacaccaccacgccagttaatttttttgcattttttgtagagacagggttttgccatttgtccaagctggtctcaaaatcctgagctcaagcaatctgcccgccttggcctcccaaagtgctgggattacaggtgtgagcgactgtgcccagcccaaaaggcatcctccttatttgcagccaagagaaacttaagtcagtgtaacctttatggaggaaaatttgccactacataacaatactatatacatgtcattttgacccagtattcccactcctaaaaagttaccctgaatctatatcccaaacaatacaaaaattcatatccattaggttattcatgacagcatcacatgcaactgcaaatattgggaacaacctgtatacccatatgtagaacagtggttgcataaacacactggcatactacactgatgtaaaaagaacgagtgacttccaggttataataaatgaaaaaagcaatgtgtacaaaagtatccatgcctttcgtgtaaggaggaagagaaaacaatgagatatgcatgtatctgcttatttgtgcaggaacaaacacagaaatgatcaactagagactagtaagatcatatatccacagaagtggcttggaatggcaaagacaacacagaaggaatgaaggtagggtgacacctctctgaatatacctaatagtccaggtctggcgtttggaatcatattaatgttttatttactaaaaaaaaaaaaatgaaataaggacaggagagggaaattctgaaatgaactacaaacagaaacaaataaacatacttgtatttcaaatgattaataatcacactgaagggggaataaataaccaaatcaactttagaatacaatctttggatcatgtgctcttgggctgaagacgaaaagaacacaaaagaactcttagactctagttacaggtttctttcttcacagagatatggtctatcaattgaaaaaccgtttcctgctattctaggtttgagcaaataagtaaatatataatggaagtcaggtttctcacagtcagagggtaataaaacatataagaagaataaaataaactgttgaatttgactagaaatggaattagtgtgagttcatactttctatatatttagagagatatagaaatatagatgtataagtatgggatatgtgtatgatataaaaacacacatatgtaaatatataaacaacatacacaaatatatacacacacagggatgtatatgtatgtgtctatatattcatttgtttcctaattccacctgctgaaaggggctaaaagcaatttctttggaaaggacaaaaacatacttttagataatttctcagtgtcaaataagaaatcatactgaaaatcatgaactatactggaactgaaccacaaaaaatacactacatataaaaatgtgtgtgatacaacttagcatttcttaaaacaatttaaaactttaaatgcataagatagaataggaaaagcaactgaaagccttttttggaatattctgttttacttaaggtacactcaggaggagtcctaatttgggactaaacatagccttgaaatgacatggcaaaagcataacatgtggaaaagaaaggtgattatctccagggaaggagagagaaaaaacccatacctatcgtaattttttctttaaacaaaaagaatctgaaatgaatatcccaagaagttaccatttgttaaatgcgtacacgtgtgctggatgtgttacgcaatcctcccgacttccctaatttgacctataaagtaagctcttcagcgctttcaacgagaactgctgccctttcttcacacacactaatcaccatggactcggacaagcaagtgtgaacacagtgttcagccccctgcctctctccccagggagggcctattgtcagaatgtccccctcccctgcctttacaggctctagtgggcggctctagctgtgacctggtgagcacatttaatctaatgagaaaggattcccaaccttcacctggccacacacccaaaccacaacttcatctataggattcttctatcttcctgaatgtgttctaaatttgagaggggaagagcatgttatttattggccttgactgtctcccaaatcaaaaacgttacccttttttttaggttctacacaaatttacaataactagtttatagttgtttatagtagtttataactacagaaaaaacctgaaatgtattgttcctaataaagcagcaatgtcattaattttattttcatgaataatcttccttaaaatttctaaggaccctatagaagtatgccatctgcatactaattcagactttgttagtaagaatttgtgataattttgacaggggtgagatattaaagttcacctgtatttgttcttaaaaagatctttttaaaaaaatacatattgtaataacattatataggccatatttaatctattttttaaagtaaacttataactttttctttttttttttttttttttgagacagagagtctcactctgttgcccaggctggagtgcagtggtgcaatctcagctcactgcaacctccacctcccaggttcaagcgattttcgtgcctcagcctcccaagtagctgggattacaggcatgcacccccatgcccagctaatttttgtatttttagtagaaacagggtttcaccatgttggccaggctgtctcaaactcccgacctcaggtgatccgcccgcctagggctcccaaagtgctggaattacaggagtgagccaccaggcccggccactttttaaacaaatgtttaaaatgccttttaactcatggtaaccaaataaaaacagctgtatattataaagacatgagatctcagcgaaggtgtctcttgagatggaactggaataaacgagactctgctatgcatggttgcgtttcttacagcatctgtgcttctctttgtgcatctgccccgctttcctcttggcatcaacacaactactcgacactttagcttgcgtatggcccgtagtggctgcctagtcaaccttcctcatagaaacgttccaggttttcagcttctgcattgagtcagtctcgcagttttccagttccgaattcccaagcttcagggaagaagagcaatgcagtatagcacagtggttaagaatagaggctttaaagtcaaacacacacaatttcaaatcctggcacctccaccagctgtgtgacttaagctctttgtacctcagaacaaaatgatgcggctgcctttggatcaggtgtccactctagacccaatgaatgtggcagagaagggaagatggtcctatggcagagaacatggtgggcagcagtcagagctgtgggcagggcagattccccaatgtggggttaagtgaggaataagtggctgagtacagtggctcatgcctataatcccgacactttgggaagccgaggtgggaggatcccttgaagccaggaatttgagaccagcctgggcaacaacgtgagaccctgtctttaaaaataaaaataaaaaggccaggtgcggtggctcacacctgtaatcccagcactttgggaggctgaggcaggcgaatcacttgaagtcaggagttcaagaccagcctggacaacacggtaaaaccctgtctctactaaaaataccaaaactagccagacatggtggcaggcacctgtaatcccagctactcagggggctgaggcaggagaatcacttgaacacgggaggtggagtttgtggtgagcagagatactgccatcacactccagcctgggggacaagagtaagactttgtctcaaaaaaatttttttaaataaaaaataaaataattagccaggcatggtggtgcatacctgtagtctcagccacctgggaggctgaggcaggaggatcacttgagcccagaggttgaggctgcagtgggctatgatcatgccactacactccagcctgggtgacagagcaagatcctatctctaaaagaaaataagtaatgacatatctagtatatgttgccatctttgaatgatttggatccaatcatttaaaaagcacaaaaggaaaatactttggtgacataaaggtaaacattggcattctatcaggaaaagagcaatgaagtaggactcggtgtgccccggagcaaggcccagctcggtcacgtgccaactttgcaatattggtcaaattgcttgaacaatcggtgaaatctctatgaacctcagtttcttcctttcaaaatgcagataataacaaacagccacataggattctttggaggataaatatattaaaaccattttgttaacttgaaaacactcaaggaagtattattgtcctttattagcatattttactccccataagggttacatttatttcacacttcattgctaatgcaaattttgactgcagtaaaactcaagaagctaaatatataaactgctaaaaaatgggttttgcaaactcaattcctaaggaaagcatccaagaaatgtaaaaatatgttccaaattaaacctgttgtgtgaaaatgtgtcaaaaatgtctctgtcagtagaggcctcttgaccatcatattctactgacactcatttaaagcagtatgtttttgtgagaagtgctgagttctctaaagacatatctacaaagaaatacttcacagaatgaaaatttccctctcaactggaagcaaggtaaccacacattgctctcttctcttcgagctttacattgtgcttcttggagggttaagccagcatgttcactggagcaaaggaatgtttacaataaactggaaaccttgcctgctctggatctaaaatggttgcagatgctcaagcagagaggagaaaagagaacagctgctccccacccccaccattgatacttaagagagctatttttaagaagaaaattatattcagaggttttaggcattttgtttatttttaattttatttatttatttattttttgctttttgagacaaggtctcactctgtcaccctgggtggagtgcagtggcaatcagttcactataacctcaaactcctgcaatcctcccacctcagcctcccaagaagctgggactacaggtccacacctctacgcgggtctatttttattaaaaaaatttttggtaaagatagagtctcactatgttgcccaggcgtgtcttgaactcctggcctcaagcaatcctcccatctcagcttcccaaagctctgagatgacaggtgtgaggccactgtgtctggccttaggctctttctaaatggtagggataacttttctcagtatcacacaaattattatatcaatacaaaactgaataccttaaatgtgcctaccagaaaagaatgtaaattcttgttattgccttctagtaatttagctattattttcaacttaaaacataacgattccagttacaagaaaagcaaactattatattcccagtaaatttagaaaattattaaaatgaaacatctttaatatataataaacatatagtcacatcatagccacaacctgcaaaatgaatgagtacccaatatgggtaagataaaccttgcatgatgaattggaacatcctctggtaaaaaatagtttgaaactattaataatagtttcaaacgctatcaccattctaaactacacgatttcgtcataataaagcaagctaaggaacaattaacttaccaagtaaagaacttaaaatgtttctaattataatcacataacaccccattaaaaaagaaaaagccaaatcaaagaatcagacatcaaaaggccattaggtctctcgatacagaccatttccagacctagtttactccacataaaactccattggggcgttttcatttttcactaagaatagagatatatggttcaaattactgtttcttcaaagtccctcgacatttgtgtattctacaactaaaatgaataaattttatatcaagtaataaaaaacttgaggattcaggctttaacagtaaccagttttaaaagaccattgttaaaattcatgacatcaaacttcagggactatgatttaggaaggaataaaggaaattcaatgaggaaataaacacaagtttttgaaggatagaaatgtttgacatttatttatctattgtttattataatctgacaaaatctttcttccagaaaattaggtctgtttgctgtacctctaacctcatgcttggacattaatatggcatcagactcatgcccttggaacatgttattccttctggttggaaaattctctctcctccaccagtttattttctgtcccttccttcaaaacttagcttattggcaagaaatattcagggaagtaagcttttctccaatgtcactttgatcatatactctgttaccaattcttcaaccattgaccatttgggggaatttaaggtctccctcaaaatgtaccaccaggctctgcgctttctgttccagctggctcatcttctcagcttttttttctttttttgagggggacagagtctcactctgtcacccaggctagagtgcagtggcacgatctccactcactgcaacctctgcctcccaggttcaagtgattctcctgcttcagcctcccaagtagctgggattacaggtgccggccaccacacccagataatttttatgtttttagtagtgacgcttctattaaagaaatgtctttagtagaacatggagaggggtttctccatgttgaccaggctggtcttgaactcctgacctcaggtgatccacccgtctcagcctcccaaagtgctgggattacaggcgtgagccaccacgcccggccatcttcttaggtttcttcacatacacccttgcactctccatctctacatattagttcatgatcttctaacttcctgggtaattttactatatggaagaataaatctatagggtatacaagccactgtgttcaggatataacttgggaacaccattaggaagagatctactattaaaattagtaccagattaacagttaacttatggaaatttattacttatgaaacttattttctgagtctctatgaagaaaccagcatattcgatagctaatagccaacatatctatgagaagtcaccaacatggaagatgtttttcctatatttcagagcactatttaattttgctttcttcctttaaaatttaacacacaggcttaagtccaaagtgaacctaattgaggttgaagaagtattgtttcggtatggctgatcttttctcagtcgtggtttttgatttttttgtttgtttgtttttgaaatggagtcttgttctgtcacccaggctggaaggcagtggcacagtctcagctcattgcagcctccaccacccaggttcaagtgattctcctgcctcagcctcccaactagctgggattacaggcatgcgccaccatgcccagctaatttttgtatttttagtagagacggggtttcgccatattgtccaggctggtctcgaactcctgacctcaagtgatccatctaccttggccttcaatcatgttttggttgtaaaacttcatttatcattgtgattggcactattttttggatttgcaaatatataaaaaaatttaaaataaatacataaatgagctgctacaggaaaagatggcaatactgacatagtaaaaatggccagcaagtataacaacctaacgatttattgtaactttctgggtataagataatggtgtttttatttactatatatttttaaatatttttctttttaatttttgtaggtacataataggtatatatatttatggagtatatggaatattttaatacaggcctaatatgtgtaataatcacatcagaggaaatggggtatccatcacctcaagcatttatcctttgtgttacaaacaacccaattatatgctattttttatgataataactatacatggatggatatggaaggtaaaaattcgtcagagtgcttttggtactgattagcagagaaaaatgtgctttatgatagctggcataagacatacaggcaaaatatccccgaagtagagaagggcaacttgcccaacttaactgcttatcctaactagatagaaacaccatttaagaacacacaattctcttagttataattctatgattatcagacaacatttcaactgatggtttgaattcttgaacagactagcccactagaaaaacatatttttatcaagtgcctggaaaccctttaaataattttcaatggcttttctccttttgtgggcgatagctgcagttccaattagggtaaaagggaaatgtgtgtgccaactgccagagtattattttggagaccaatactgaaagccaagtatacaaacagtaagctgtcccagcaattccactcctgggtatatacacaaataattgaaaataggtactcaagcgagtaattatacataaatattcatagcagcactattcacaatagccaaaaggtagcaacaacccaaatggccatcaatagttgagtaggtaaactaactatggtatatacacacaatggaatataattcagccatcaaaaggaatgaagtgacaatatttgctgcactgtagatgaacctagaaaacattacactaagtgaaagtagctccggacacaaaaggtcacatattgtatgattccatttctatgacatatccaggaaagataaatccctagagacagaaagcagaatggtggttaggaggatctgacagaaggcggggaatgggaatccactgcctaataagtataggattttatttgtgatgatgaaagtgatctggaactaaatagaggtagtcattgcacaacaacgtgaatgtactaaatgtcactgaattgcttactctaaaatgtcaattttatgttatgtaaattttacctcaatttaaaaataaatgactgtagctgtaactgtggagcaggagtccaaattcaaatgcctacaggggccaactaacaaaaatgaggacagtgaaccaaagaccgcacgcccgccatgtaattatattcctttaatgttgtttaatttttgccttttagtcttttatatagttgggatatgtgtcccctccaaatatcatgttgaaatgtgaccttccaatgttggaggtagagcctagtgggaggtgttggcttatgggagtgactccctcatgaatgtcttggtgtcagtcccttggtgatgagtgggttctcactctattggttcatgccagagatagttgtttaaaagagtgtggcaacccttcctctccctcctgctccgtctcttgctctgtgacatacctactccccctccaccttctaaccatgagtaaaagcttcctgaggtcctacaagaagcagatgttggcaccaagcttcttgtacagtctgtagaactataaacctcttttctttataaatcacccagcttcaggtattcctttatatcaatgcaaaatgaaataaaggaatcagagaaaatggagactaacagtcttttctccgcttttcctgaccagtctaacagagacctgtttaatttgttcacttattttattaaattggttttgttatctctctacattgtgtttctgatttcactgatctctgctcttagttttactatatttttcacacttactttgttgctttttatctagtgttttgaggttaaggcttagcttatttcagtctagataccaatttaagatactctacaacatttgatgagtaatgctatcattatctttcagttttaaatatttgacaattttattgtgattttctttttaaccataacttatttaaaaatacaattttacatttccaaacctaaatccaagggttttttttaaactggctgcttattattgatttctaatttgattgcacagagaacataaaatgttgtctctatgacagtgatactttaaaggcagttgtgacttctaatataaccaatcagttccacttgttgccttgacaaggcaggggtcagtggtgccagatctcacatagttcaaaagaaactagaaatctaaaatttatgtgaaatcttctgattttataatgttggcaactaattgaaaattttcgaaacgttgcacaggccaaactaaatatatatgcagatgactcaacctgcagcccaggaatttataacatctgctggaaagcctgaacctgaacagaagaccgacaaaacagacaagaaaaaaagcacaaaagcagcaaagataagagtaagctacaggagaatattatgaaagaaaggaatggcttatatgacacaatcctggaactctgcctaacacaaattttaaagtagaattttaaaattggaacatacataaaaatattaaaatatcatatattaataagtgccataaagaaaattaagcaaatagcccaaggccaagatacacatttgtatagcattgctgtaaggatggcacagaatgatagttactgaagctatactttcgaactggattgtctcatgaaataatctagagtaagacaagagtaggatgaacatgcaaaaaagaccaagagggatgacgaaaaccaaaagaatgtgtgccacagaaaatgaagaagaaaatgtcctgaggaagaaagactgaacaaaatccagattggaggtcactggtatccctaggaggagaagttttggtaacatcagggaataacccaaactgcattggcttgaaggtagatgatgagaaatctgaggcaatgagtaaaataactccttaaagaaacctgaatataaaagcaaagaaagagagagaagccgcagttgaaggggttggagtgagattaagaaaaaagttttaagatggatacttactcatgtctaagtgttgaaaggaccaatgtagttaagagataccaagagggccctgaattagacttcaaaatggaggaagatgcaataattgtaagaggaagcaaagaactggtggaaggattggtacaaagaaaacaccctataaattaacaaaatacaagaaggcaagagtttaaaagaagaacattaatgaaaccagaaacaatattttggcctggagtcacaagaatagaagtagtatcacttttacatctaactagtggtggatgacaggagaggtagaggaggaccacttgtcagtctaaaagtgatggctaaggttttactatacactccatgaacaaatggtgccaggaataattttttaagggataaaagcttcagaagaagttgtctatggtctactatattaataaagcatatattcaatggtgtgaaaaatcaaagaaccgttcatgacaacagagaaaatgatgatgtttctggagtaaaagaaaaaccatttgggagatcatgagtcagtctttgattcacttattaattttgtagaaagctaaccgtgttccactgctcaggaggtcatacagctctgcatgcctcactccatcctcttgaagatgaggcataagaccacaaagcaagctgagatcaagggcttttgttttttttttttttaagaaatcaagtttcaaagtaatggaaaggtcagtgtgcatttagagtttaggcctacaaactaatctgtgattgaatctacagcaaatcacgataatttattccaaaagtgatgatgctgacttatcctaaacttatccattatgcaactgtaaagagaattgaagtaatagatcacatttcaaaaagaatcctatcaaaaaatctcagtaagaatagctctaggtttcatagataaaatgatatctggctaacatctctccaatagtctcccccaagtgctcactaaaatacctagaaagagaaagggggaaaaaaaataaaacatcgcaagaacagtaataactcagataaacagaaaacacagtgaaagaacctgggcagaatctccaacaactataaagtacatggaaatagactaattaaaaatatatctatacagatctacctgaaagcaaatgtaaattagcttcaggaaacagaacctaagaaaaattatataggaagacacattctacctccctcaagtcaaagattctgtgttgaaaaaaatcaaaatatttactatgtgtgattcttctatgataatgctttttccttccatggtggtacgtttttctaacatctactagtgtttcacacacaatcattcagagccagcaactcccaaaatgcatcggattaaagtaaagtacaaatgatgttggtgtactatatgtagggagccatcatctccacagctaaaggaatatacttggacacaaaaagagggaaaacaatctgagttcaaaacatactgagaactatacgattcattatttcattcaaaaaatcaaagacttataatataagttataaaaagatatatcactagtaaagcagagtttctacaggtaaaataatcctagaaactgggaacttcactggcagctgaccaatgtttttatccacctgaaaatcttcaagagaatatgaccattatacaagttgacatggagaagacacaagacaatccatacccaaaatacacagtagactaatatcagaaagtccctagaaaagtgtacaaacagtgagagctcaacaagtgtttgttaaataaacgaaacaccaagactttacaaaatctcccttattcattattgagtaatgagaaaaaaataccagttggagactaaaagctattgtagaaccaggggaaaagaacaacatcctataaacacagaataaaaatataccatcaaaataatctaatatccagaagaaaatatcagaaaagtatgaggaatcgtaaagaagaccgtctctatgaaatacaaggtaaaatcttaagaattagctaagacaaaaagagaacagaataatatttaaaaggggatatgattaagatgaaaaatagaaaagaagcaaaaatgcagagcacaataaaaattcataatggaagtggcaaagagcaaaaatgcaaatcagtgatgttgtaaaccatcccatatactcagaggacaaaaacaacacatgaaaatatgagaaagaaactagaaatatgaaagaatgataaaagagctacaaaagtgaaaatggaaaataaatgctaaaaaaaggaaaacaatattagaaataaactaagcttaaactttttaagggaaaatttaaaatgttgatgtcttactgtatcctagcacaaacagaaaaaaagagaattacatctgattcagatttctggtttcaaaatggcggcatagaagctggcttcactctcccacacagaaaaccaaaaacaaacagacagcactgagattatcaccagcaatatcacagaactcaaatatgagaatgaggcagttcccaggaccacagggaagtaaaaaacaactctgagcagagagtaggagaaccacacttccatgtatacaatgtccctcccctccaatctgcccaggcatacagaaaatttcccctcgacccagagtttccacactagaaaaagatcaaggtggacaaccagcttctccaacatattgggttccctggcagaggacctgtctctgccttaagccacaggaaacattgtgagttcctgaagggagaaatattcctgaggatagccagagacaaagggagaggtgagtctatcattctcagtcctggaaactctgttctgtaacttggccaaaaaagacaccaaatcagagtgactgttcaacagcccaggtcccctaggcacaaactcctaacccgccttcccacactactaggatatcccatttaggactttccatattcaggacaggtggcactctgattgtttactagaaccaagcaaaacctgggcttaaggtgccatctagtgacaaaaaggaggcagtgatctagcgagataagaaagaaagaaatcaacaaatcaattataatgaatcactaaagcaaacatatccaataaaaaacaaaacaagtcaggcaaggaaaactgaataaataactaatccttcaatgcaaagacacagatgaacatcctcaagaaacaacagcaaacaacgaaccatgaactcctcaaagagacagagcaaggaaccagcaactgactagtatgaaatgatatgtgaactctctgaccaagaattcaatatagcatttttaagaaaactcagtgatctccaacataacacagaaaagcaattcataaattatcagagaaatctaacaaagaaattaaaataattgttaaaagatcaaacaaatcttagagttgaaaaatacatttgctgaactgaaaaattcatttgagactctcaatagcagaatggttcaagcattgaaagaacctgtgagcttgacaactggctacttgaaaacacacattgagaggagaaaaaagaaaaaagaatgagaaaaaaagatctcctacaagatacagaaaattatcttagaagacaaaatctaagaattattggtgtccaagagggagttgagaaacagtgagaggtagaaagcttattcacagaaataataaaagaaaactttccaaaacttaagaaagagataaatgtccaggtacaagaaggtaagaaagcaccaaacagggccagacgtggtggctcacgcctgtaatcccagcactttgggacgctgaggcgggcagatcaccaggtcaggagatcgagaccaccctggctgacacatggtgaaaccctgtctctactaaaaatacaaaaaaattaaaaaaaaagccaggtgtggtggtgggcacctgtagtcccagctacttgggaggctgaggcagaagaatggcatgaacccaggagtcagagcttgcagtgaaccaagattgcaccattgcactgcagcctgggagacagagtgagactccatctcaaaaaaaaaaaaaaaaagaaagaaagaaaaaagaaaacaccaaacagatttgacccaaataagactatcccaaggcctataaacattgggcactcaaaggccaagacaaagagagaatcctaaaaggagcaagagaaaagaagcaaataatttaaagaagctccaattcatttggcaacagacctctcagggaaaaccatacagcccaggagggagcaggatgacagtttcaaagttcagaaagaaaaaaaaaactgtcatacaaaaatgctatatacagcaaaactatccttcaaatatgaaggggaaataaagtctttccctgacaaacaaaagctgagagaattcaccaacaccagaaccatcttacaacaaatgctaaacagagtttttccattagaaagaaaaaaatactaacgggcaaaaagaaaacatttgaaggtaagaaacccactggtaaaattaagtatatgaacaaacccagaatagtctaatactgttaactgtgctgtgcaattcactcataactctagtatgaagccaaaaagacaaacctataaaaaacaatactacctacaggaacctgttaagagacgggcaatataaagatgtgtaattgagacaacataaagtctaaatgtggagagataaagtatgtaagttttttcattttttgttttttcctatactttgagatctaagataaattttcatctctttaaaataacttgttatcgctataaaatgctttttgtgagcctcatagtaaccacaatgcaaaaacctataatagatttactaaaaataaaaagcaattaattaaaacataccaccaaagaaaatcatgtaaccataaaggaagaaagggaaagagaagttaccaaacaaccagaacacaaacaacaaaataataatatttaagtccttactgatcaataataacattgaatgttaatgaactcaattctccaataaaaaggcatagagtgtagggcagagcaagatggctaaatagaagcttaagtgattcttcccctcaacagaaacaccaaattttaacaactatgtataaaaagaaccatcacaggaaccaaaactcaggtgagcaatcacagtatctacttttaatttcatatggctgaaagatacatcaaagagggcaggaaaaacagttttgaattgctgatgccactcctcccccatccaccagccagatagcatctgtgctcttgggagaaggagagcacagagattgtgaggctttgcattgaacttagtgctgctctgtcatggtggaaaagagaaccaggctgtagtcagctgacatctgcctgcagagagggcacctggactggcccatgcccagaggtgaaccgctcatcccaaaggtcagaacttgagttctagcaagccttgccaccacaagctggagtgctctgggaccttaagtgaacttgaagggcagtctaggccataaggactgcaattcctagggaagtcccaatgctgagctgggctcagagccagtggactagaggggcacacaacctactgagacaccagccagaaaggctgaagggaatgcctgtatcagctctcccaagccctgggcagtggccatctggcatggagaaatctgtgtgcttgggagaggaggagagcagcgactggggaacttcacattgaactcagtgctgccctgtcacagcggagatctggcaggattcatcacctgctaactaaagagcctctggtccctgaataaccaacagcaatacccagataatacaccttgggcatcaggctctgagatgtcctggcttcagaactctggataggttcattttatcacaaccttctattacaatggtatacaaaataattctcttttggattaccctagaacttgagtggccacgacaaagaataaactttttaaataatttaactataatataattcagcaatttctggttacttttaatcgaactttgatataattcattgaattctaggtaagtggaatccaagttgatttcatacatgtcaaatatttccctcttgctccccaactctatacagtatctatgttgtgagaggtaacgttatactcatatatgaaaatctgacatattttggttgaatgatacgttataaattgcatgtgttcctaattttagtaatagtagcaatagaaaaaatatattcaaaagttacaaacttaattaatctttaaatatatatgcatcagttaaaaacagcaccatatcttctttattaagtatcataagttataggttacttttatattctggtagaatagtatttagaactaatctttcaagaatactttttgaaagttcgaatttgttttctaaacagaataaaatttcttatgaaggagaccctacaaaggtgttttcacttacatattaggtacagaaatctttgtgtttactattcaagtttgcaggcttccttttaggctatttctagatgtctccttaattcaattttttttccattttaaatattactattaatttcttgagatatttttcaccaaccttacaaacaaaatgatcaagtcacaattcctcactttggcaattttaaaactaaattcagatttatactattcagttatactttaaaatcccatacaagaccaatttaacctagctttccctgtctaccaaaattcaaaattcaagctcctaggtaaactggaaggctgtctgcttttaatacaacttcatccaaatttttgcagtaggcaatgttccattaaaaaaaaaaacaaacctaatcaaaatgaagttcactctttctatgaataatcacaagattgtttagtattccatttaagtcttttattaagattagcgtctagcaaataaaagtacaaaaacagtcattatgactttgcagttttagtatctttaaggtattcctatttgaagattaatccctatttcccctaatattataaatgttgatttataacaacaaacaagcaacaaaagataaatgaagaagatttaaaagtgtcataggaaagctttttcactcatgtttaaaaatataacttctttaaaaatataactttaggggtaaataatgtttttccactgtaatggaatattataaaaactatgcatattaagcaagaaaagatatgtttccaagaagctatatgtcagtttgttggaaaaataacaagtaaaagtgaagaaaggcctccaataactccaataacttcttccctttggtctcaaactgactgggttcactcacttctattggttctttgataatgccaatgaatagtctaaaatttctgcttactccagggactgaattaggtacagaaatctttatgtttactattcaagtttgcaggcatccttttaggctatttctagatgtctccttaattcaattttttctccattttaaatatcactattaattccttgagatatttttcaccaaccttacaaacaaaatgatcaagtcacaattcctcactttggcaatcttaaaactaaattcagatttatactatcccgttatactttaaaatcccatacaagaccaatttaacctagctctccctgtctaccaaaattcaaaattcaagctcctgggtaaactggaaggcttaattcttcccacatatgtgtattcttttttgttttttatttttacttttaagttcgagggtacatgtgcaggatgtgcaggttagttacatatgtaaatgtgtgccatggtgatttgctgcacccatcaacccgtcacctaggtattaagcccagcatgcattagctatttttcctaatgctctctctcccccacctcaccccctaacagggcccagtgtgtgttgttcctctccctatgtccatgtgatctcattgttcagttcccacttataagtgagaacatgtggtgtttggttttctgttcctgcattagtttgctgaggataatggcttccagctccatccatgtccttgcaaatgacatgatctcactgctttttatagctgcatagtattccatggtatatatgtaccacattttctttatccagtctatcattgatgaacatttgggttgattccatgtctttgctactgtgaatggtgctgcaatgaacatatgtatgcatgtatctttgtaatagaatgatttatactcctttgggtataatatgtgtattcttaacaaaacataaaagcatgatgaagatatatacccagcagaagtgtgtatatttagttaccaaaagaaacatataagaatgttcattgcagcactattaataatatccccaaaccagaagcagcccaaatgaatattgacagtagaatggataaatatatggtggtatattcaccttgaaacactattcaacaaatgagcatgtaaaaactacaatgatacacaacaatataaatgaatctcacaaacctaaatattgagcaaaagaggccaggcacaaaaaactgcattctgtatgattttatttatgtgcagttcaaaaatagataaaaagtgaaaatagtggctgctcttgaaggtggggcagtgacggttaggggcttgggagggaggcttctgcaatgctgttaatgttcagtttcttgatctaggagctgcttacatgggtgtgttcagtttgtgtgctttttggtatgtatgttatacttcagtagaaagttataaaaaccatgagactgcaggataagtcccctcaataaacttcggttcataggaaaaaaaaaaaaaactgcatggagtcagaaaaggggtgttatatgtcaatatcagatacatatgagcagaagacatctccagttcatggccaatacggcttgtggctagggtgttttctaaaacccataatctgagatgaaataaacatcctaatctgggcatgacagtaagatttcaaaggacaggattagtgcaagtctagaaatgtcaccatgcactttttcccttgcatagttaggctttcattgagttgaccacatatgtggtttacctctcaatctgtgggacctcaaaacatcatttggcttctttttgttgttgttattgagacagggtcttgctctcttacccaagctggagtatggtggcgtggtcatagctcactgcagtctccaactcctgagctcaagcaattctcctgcctcagcctccttagtagctaggactatagaggcatgtgccacccagccagctaatattgttgttgtttttagagatggggtcttgctacattgcctaagctggtttcaaactcatggcctcaagcaatcttcctgccttggacttccaaagtgctgggatttcagacatgagccattgcacacagccctcatttaacttctaataggaattttgtccacaacgtacagaaaaatagttctaggagaataggatgtgggggaaaataggaaacacacggagagccaaacatgtaaaaaagaacacactcatggcacttccttgaaaggaaaagaacattccagtttcaacactccctgtcaagtgattacaatactaagtgatcatttggggcagttcatttgtatccctgcctgctgtggggccactttcggttctctttctctctctggtgccattggcctaatcacaagtgagaatgctgcctctaagggctccaccatcaacccctgaactaaacatctttcatgtgccccttcggcacactcattacccttttgcacccagttctgtgccccaggggtgagtccctttgatctccatcaaacccgaagagctcccttgcctttgggtttcaagttgaattcagcaaggagcctgatcatcagagtcccatgttgttagggattaaaagaaaatggaaaggctgaagagttcttggagtggggtggggtggggggtggggaggcaagttttattccccattcctctcggaattctaacctggctttgattgtttttgttcttccttccttggggacaaggaagtgggtaaatttatcttcaaagattaaaacttcacaaaatgttggacaaaggagaatgatatacagaagtgctcatttcaaaaaaagaaaaggcaaaactggatcctgttcaaatagacatctttgatataggtgggaaaatagaagagggtacacctagatgttctccagatagcggctcccttggctgaggttcaagtatagttcaaaatctactgctccatctctggtccctgatatgtctccagttagagcatcaaaaagtcacccaggacaagtgctcttgttctagggcccacccagcacttccctcagtgggcttattcagtcctcggagcattctgggcatttagtaggcaatacaagaaacagcaacatctaaaaacaatttatctctcaagttttattgaaatttctcttttacaaaatgtctgatttttaccctaacgactgcatcctcacccaaatctcatcttgaattgtagctcccataattcccatgtgttgtaggaggggcccagtgggagataactgaatcatgggtacagattcccccatactgttctcgtgcagtgaataagtctcacgagatctgatggtttacaagggaaaactcctttcacttggctctcattctctcttgcctgctgccatgtaagaagtgcctttcgctttccaccatgattgtgaggcctccccagccacatggaactgtgagtccattaaacctctttttctttataaattacccagtcttgggtatgtctttatcagcagcatgaaaacggcctaatacaattcctaaatattttttcatcatggcgtgttttgactcaaatcctacaccatggggaaaaatatacgtgtgtgtgtgtgtgtgtgtgtgtgtgtgtgtgtgtgtagtacaataagttaaattccagtgtttcaaagtttttaaaatcattatatttgtatctttataaatcatgaaacagtatttaaaaattcagtatttcactaaagcccaaaaacccccccattatgcagtatatccatgtaataaacctgcacatgcaccccctgaatctaaaagaaaatatttttaaaatcaatatttatacttcagatttccatttactcaatctatgttatatctatatgaaacaaaaatataaaactatgcagcttttcatcagctatctcttagaaattatttgtcgaagtttattaactgtggaagaaaaggtactcagatgagactggagagttccagagaagctccttgtcctggcacatctgatccgctgtggctgcagccaacctctccatcacgggctcaccactgtcccagagtccactgtctcttacatggactattatgatagcttcatcttccttattttcctgcttccactttctcattacttaaatttatattttcattcctgccaggataatctccctaaagtatagttcattcatgatatttacttaccctgaaatgttaggatatttaggaatcaaaataagtatgctaaaatcagattcaagtttacaaagtaagattgataaattaaaagtagaagatgaatctatgtatttacacatgaattcacacaagaagaaagcctgaagcctcttacatggagaatactttttcttttcattaaaaaatcctggatgggcacggtggcccacggctgtaatcccagcactttgggaggctgaaatgggtggcttgcctgagctcaggagttcacgaccagtctgggcaacacagtgaaacctcgtctctactaaaatacaaaataaattaggcaggcgtggtggtgtgcacctgtagtcccagctactcgggagactgaggcagaagaattgcttgaacccaggaggcgaaggttgcagtgagccgagattacgccactgcactccagcctgggcaacagagtgagactccatctaaaataataataataatcctaattgtacacttattagaaagctctctttcctattctataatccataagcctcctaacagcatctcttaacaggctgtggtagggtgtcctttcattctaggcgagaaaaactctcacctgtttaaaaacaaagtgtgtcatccctgacaactctccatttattatatgaaatacacagaaggctgttcagtcaaaaactcaaaatagagttttagctatttccagaaacctggtttacactctgctccactccttactggcttaagtgatttgggacaaactgaaagcatctcaggaccttgaggaatcctcagacacgtttaattaaaaatatatgtaaaacataaatacaatttttaaaacctcatatgcttcccaactagggtgaacatacaatatttaactactattaatgttttattataatttttccttctaaaactttattggtttgtctttattattgtcataagctataaaacatacatatatatgtatgtttttatataaatataatgtctagatccctttcaatgcatttatacacacaccctaaacatccccccccccacacacacacacaatcttttttctaaattcactcttgtatcaaagttaaaatattggaaagcaaagtaaccaggaagcaacatattgaggctaccttagcttaggtctctacaatatgccaaagcacatcttaatataataactttcagcttttattgaaagtcaaaataagaaatagtctgcattttctgcaaaatgactattgaagatcttgtcagaaaaaaacaatcattattttattttaaaatttggtgccatgagagatctttttggggtgatagaaatgttctaaaattgtgcttggggtggtggctcacacctgtaatcccagtattttgagaggcctgaggtggatggatcacttgagctcaggagtttgagaccagcctgggcaaaatggtgaaaccctgtctctaccaaaaatccaaaaaaattagctgagcatggtggcacatgcctgtggtcccagctcctcaggaaactggggtgggaggatcgcttgagcttgggaggtcaaggtagcagtgagccgagatcagcccactgctgtccagcctaggtgacagagtaaggcctcgtctcaaaaaaaaaaaaaaaaaaaaaaaggaaatgttctaaaattgaactgtggtgatggttacaaaacacagaactctgtgaatttactaaaaatcatatattgtgcacttaaaacaagttatttttatggtgtgagaattgtacctcaataaagctattttctttaaaaagaaaaaaaactgatgtcaggaaaagattacttcttctggaaaacctgttcatatgattttataaggcaatgagaaactaagtaaacagagctaatacacgtatataatatagtcgttataataataatattaataatacatatataacagacactattctaaatgctttatattaactcttctaagcctctcaataatcttagagggaacatcttattatcttattaatcatcctcatgttatagatgtaaagcctgaatcacatggaaattaagcatcatgcctaaggtcacacagtaatttaagctagaagttggacggatgacaaccgggtccagagtccatgctcttaacccacactaaattcaaactgttcccaaaaccacctaaaagagttcaagtcaaagcaaatttagaatttaaatacagaaatacttttatatctagtataataatatctaccattctccacgtttgttatattttaattacatgttaatatgtttacaagtcattttaagtctgttctagaagtaaagacaaatattttattcatcatttcttataatactttcactgtatcagtgttttataaatgcaagaaatatttacttgctgaaatgaactccaatagaaattactaaattctttttttttttttttttgagacggagtctcgctctttcactccagcctgggctggagtgcagtggcactattcggctcactgcaagctctgtgtcctgggttcacgccattctcctgcctcagcctcctgagtagctgggactataggcgcctgccacagcacacggctaattttttgtatttttagtggatacggggtttcaccgtgttagccaggatggtctcgatctcctgacctcgtgatttgcccacctcggcctcccaaagtgctgggattacaagcgtgagccaccacgcccggccagaaattactaaattatttttcctatatttactcattatttgagtgatataatcctgaaagcattttttttttttacttaacttttaagtctggggtacatgtgtagatttgttatataggtgaacttgtgtcatggggtttgttgtacagattatttcatcacccaggtattaagcctagtacccgttagttatttttcccgatcctctccttccttccatcctccatcctgccataggacccagtgtgtgttgttcccttctatgtgtccatgtgttcttatcatttagctcccacttatgagtgacaacatgcggtatttggttttctgttcccgcattagtttgctaaggagaatggcctccagctctagtcatgttcctgcaaaggacatgatctcattattttttatggctgcatagtattccatggtgtatatatatcacattttcttcatataatctatcactaataggcatttaggttgattccatgtctttgctattgttaatattgctgcaataaacttacatgtgcatgtgtctttataatagaacacgattttctattcctttgggtatatactcagtaataggattgctgggtcgaatggtacttctgcttttaggtctttgaggaattgccacactgtcttccaatggctcaactaatttacactcccaacagtgtataagtgttcctttttctctgcaacctcactggcatctgttttttttttgtctttttagtaataaccattttgactgtaagatggtatctcattgtggttttgatttgcatttctctaatgatcggtgatgttgagcttttttgcttttttgcttttttttttaaactgttaagaaagtgtttgtggttttattgtatcatgaggcattgaaacatctgaacaaatcaatgtctgggcggggtgaggcagctgctttctccttcacttctttggattactagagcaacttgtcagtagattaaaaaaaaaaaaaaaggataaccttttgcattacttaagtctttccaaggcatgcactggtacaacacaaacttctcccgtagatggaactagtctagcgtccaaacatcatgcataacacttcggtggcagcagagcactgcgcccactctcaccgtggtgctgctcatttgtgcatgatatttggagcatctggaggagcaggaatagtattgggaagaggagggaggaggaaacagcatgtctggctgagaggaggtcagctgaagttgtgcagggcaagcctgaacatgtcattggtgcaaacccaagcatcgttgatgttctttaataggaacatctggtggaaccccatgatggggtcttcatgtcttaagctggtccacaaccatgctgatgatgcagctatctggcatgggctgatcgtcctgcgctgtgatgctgtgctggattttctgaaacggaaggctagacaacttctctacaatggcagctttccatggaactgttgtccttcccacataaggcatgacacgtcaatgtaaattgcgcctagttgggttctatcattatcaaataactggtagcaacgttgaatgaagctggatccaatctgctcccaaatgggcttgtctcccactctggagcgtcacccggcctcagggagacctgaggggctggcacaatggcagcagcggtggcagcaaaccagtgtggtctgcgtgagctttttttcatatgatggttgaccacatgtatgtcttcttttgaaaagtctattcatgtcctttgcccactttttaatgggttttcttaattgtaaatttaagttccttatagatgttcgatattagacctttgtcagatgcatagcttgcaaatattttctcccattctgtaggttgtgtttcttttcatattctagtgaactactactgtacatatacttaatactaactgaaaaatagaaagcttgtccacattagtgtcagggttaaaaatatttagaatgtttatgacaatgcaaaaagagtttaaaatatcagaataaatatgttaaggcatttttgtatttattgtaaaaacagagtttgaaaaattaatcaaacagatggttttggaagttttaattgaatactttaaaatagactatacactgtctcaaaataattcttcattatgtttacagcaccaaaaacttaaaaaattaaatttgataacacaagaatattgaaaaaggaataaaccaaacttatactatccacatttgttgtttatgaattttaactcctccgaaaatactatttggttttataccatcattttcctttcattacagtctatttagttccccatatgctttaattacttatctttgaaaaatgaaaaatgaacatgtacaactcacaccattaaagtttcagataactttccatttctggaggctattaaaattattttctacagtaaaaaacgaaataggaagcaaaagtatttaatacatatgtagaacaaaaattgaaaagaatagtaaggcaacaacattaaactagtttcatttttagaaacaatagcaacaggcaaattagctttaaggagttagcatttaaagtgaaacatgctaactacaatcctccttcttaaataatgataggttctgaaatatcaacttgagctctaaaccaaagatgagttgacagtttcaattgcttggagagagtataaatatcaagcacatcatcctctcatagaaaaattcccagcctttgtctttgatacaattactgtgtcagaataaagccactcaacttttccattaacatctcaaacacattatatatcatcccaattcacaagactatccctacatggtcgcaaaattctataatctgagagaatcaaagaacttgacacttagaagtcattaggagaaaaggaaaggtattctatggaaggagtatatctggtcatgtaacaaggtgaagaaagacagcttggaaatagaaaagaaagagacaaaactagtagagaccagcatctctacagagacaggagaagatgggaccaaaatcccaggataatttattctccacttttccttcacaactcagttaaagacttttccttctctaagatgcctcccattaccagtccatcttactgattattaccttattatgtttttaaagtattttgctttatacagcatgtatcatgtttttatatgtatataaattcatatttatatatcccagttttctctgatagcctctctactatatattcaacatgcacagaagaaataaacccttattcaatgaatgaaagaaataataactacatggataaataacactacattctaaaactgagattttccttctttgcatatttttaaagaaaaaattttgttaatagtcaaggcaaatttctacatcacaaagctgtcttgcagcaaaatggaactgtctctgggccaaccagatctaacgctattcttagattcaaaagcagcagcagtcacaatattctcctttgggaaaacagccaacttgtgctgtttactttgaagttagacctcacaataatttactcttttactttcagactacattattactactatgctgggtactgtactgttaagatcatccagacatttagccaaaatgaaggtattaactatatggaagatggataaataatctacagaagaattttatttaacatgctaaaatatcttcttttaactccaagcaaaattcagtattttggcaaagacttttgaagtacctaaagagggttacttggctcagaaaatgattatgttatatatagaaaactgcagaaacttcagggctctttgactatctaccagcaccactaaaagatactatattgttatatacataaactcctaatatcacactgaaacgatcagtctgaactttaattgctgttatggtcaacaagttaatacctagttattctaagtacttcaaatgcctaacctggactggaaaatcattaagaacatcattacatcttgagctgtcttctaaaccttttatttcctttagtatgatattacaatgtgtaaacattgtaggtactaaacaaatatttgttgtcttactgctatttaaagcaaaggtcccaaacccctgggcaccatacaggtccatggcctgttaggaaccaggccacagcaagaggtgagccccgggcaagccagcattgccacctgagctccaccttctgtcagattagattctcacaggagcgtgaaccctattgtgaactgtgccagcaagagatttagcttgcacactccttatgagaatctaatgcctgatgatctgaggtggaacagtttcatcccaaaaccattccccacccaccccctatccatggaaaaactgtcttccatgaaaccggtccctggtgccaaaaagtttgaggaccactgattgaaagaaattaccccttccttagatttataaatcaataaaccaatgaagaaatgaagaaaggataaagaaatttaaaaagaacaaaggcaaagtggaacaagagagaaaaaatatggtaaatttcataaagttcatggagaaatcttcatgaagaaagtagttaattattttaaagagaaaaaatgaactaatgaagaatagagagcatcctattcattaaaaaaagcaagactgggccaggtgtggtggctcacacctgtaataccagcactttgggaggccgaggcgggcggatcacgaggtcaggagttcgagaccagcctgaccaacatagtgaaacccagtctctactaaaaaaaataaataaatccaaagattagctgggcgtggtggcgtgtgcctgtaatcccaactactcaggaggctgaggcaggagaatcacttgaacccaagaggcggagggtgcagtgagccgagatcgcaccactgcactccagcctgggtgacagagtgagaccccatctcaaaaaaagaaagcaagactgccctagttttgttcaatatttatttgacttaatatctaatgaatattattgttctctcctgatttcatctaattcatattgacaaggtaaacaaataagtccctctgtagataaaaatatggatgtcttgtgatgccatagtttataaatcgcattaaaacgttctattcaggaactgagccaatatattttattaacaagcaaagtgagacagaaggaatggttatgcaatcttcccaggcagaattcgatactaaatgtgtttgatcttgggtattctttttggcctttctttaagtcattcttatttgcaggtttagggaagcaagtaaaataaaattactgattctctgggagttagctaggtatattgagctcaagaaagcttctcctcttaaatcactttcttgggtcagtcaccgtattgaccttcctccaattaaactcttatcattctgtaccaaattgccaaatgtcttgaatatttctccaactagactatatggttctatgggaatgtactgaacattggctgacacatgatgggaactcaatatttattgagttcagacctcacaataatttatgttttaagttatctaaatgaatcaatgttttttcagctaaaaactgcaaggtcaaacctagtaataggagagcccaatcaatttagtaaatgaatggagaagacaaataaaatctaatattttaatgtatgcctaagtacagtaaaacattaaaatactgagtatatcataagacaaactctttcctaaataatgcctgtatagtaatccattttcaaatataacaactggaacatttcatttcccaaactgctcaacaaaatctacggaggaatttctaaatgtcctaagacctaaatctcattttttaaaaaatatgttttcgcttaagagggagagagcatctgaaaccactaagttctatttttttacattcctatcacttaaaaacagctgaactgatttttcttttaaaaaaaattactggctagtaataaaatcttgaagatagagatttgtgatgggaaactgatgcaaacgaatccatagcaaagctcttataaaaatatagtgtttaggtcccagttacttaatttggctcacagtttaataaagggtagttttaaatcaaatgcattacaattttactcacttcaaagcttcctcaaatttatgaattttcttttgagtatcttcttttcctttatcaagttcactctgcaagtcatgagcctgccatgacaagaacatggaaaatttattggaagacgagtaaagtttacttcaaagagacatacaaacaatgaaacagtgatcacaaatccatttttaatataaaattagatttagatatttcaagatagaaacttggtctaccatagaatgatttcaatactatactcaaatacctattttctgttcaaaatgaatttcttgagtctaccggcaggtgaattcttttaaaataaattcataacttaaaagaaaataaaaaatggaatacttcagattttttaaattatattttaatcaaagaaaagaaatcttacaagattcaagagaatacaataaacaatgtgtctatattccctgaacacataatggttatgatgaaatggtcttctcttccactgctgggaataatttgtataactatttactgagtttggaaggaaactgccacccctccccactccccgcaccatgcctacctctttcctaaatgtggatcatttgagtaaatgagatggcagcatcaataacaagggtgaaatgaaaatttgtcttcggctgggcacgatggctcacatctataatcccagcactttgggaggccgaggcaggcggatcacaaggtcaagagtttgagaccagcctgaccaacatgatgaaaccctgtctgtactaaaaatacaaaaattagccgggcatggtagcgcacgcctgtaagcccagctactcaggaggctgaggcaggagaatcgcttgaacccaggaggtggaggttgcagtgagccaagatcgcacccctgcactccagcctgggcaacagagtgagactccatctcaaaaaaaaaaaaatgtcttcacaaaaagctcttcatatgcatatgcagataaacatagccaatgtggacattttacggatcttaaaatgtaaaagggaaactttggtacagctggatgaaaaggaaggaatcaaacagcagccatggctctacatacatggcaactgaggatgcagagcccaggtgggaggtgggaaagctcaagttacttggtggggtgggaaaacccgctacagacctgctggtaagcaaggtaaggctgaaagtgaaacgagtggccaacaggtttaagagagaaacgacaagaacaacaacaaaacataaatacactatgacaaaccatatcaaacactgaatcagggctagccaaaaatacctgtagttagctatttatatcagtttaaatggagacctatttaactcaaaccctatctttaacctcttcttttaaaaattcttttggatttctgctctcagtgttttagtaaataaataaattaataaaatcaatgtttgcttataaactgaaagaaagtgagggtagacaggacattttccaagataatatcgaaaagcttctatgggctgctatgatgataatctcaaaagtaagaatacactgagaggcagagaagaaaaagcaagagaattaggaacctgtagccaccctcccccatattttaaatggtaaatttaaagtatctcataaagactatttgtcttatgagaaagagaaagaacaacttgccttgcaaatttttgccactacatttattttatcttacatgcaggaaaaagaagtctgctgttcaagtttttaccatgttcaagtgtttaattattattttggatccctaatatgtattacagtgtttggcacatagtaagcatactatactagagtacaaacattactaaagcaacaaaagcaccatttcaacgcaaatctagtctttttaatgtagagagtcaaagactaaaacctcaaaatgaaattcagatatgacctaatacaaagatcctggaaacatgtttttacatcagtaaaaaataaaatcttaagtgaaaaatcacccaccaatttaggaaaaacacacagagaaaagtcaatgtattcaagtgaaagggtgggggaaggacaattcagaagaaagttaaagggagaaactaatatgtgagatgttatcttacactggtgtttacttatacatattcacctctccttttgctttaatcgttctttcttagtcaagttctctcgcaagttgaatttggcccaaatcatacatttttttcttagatttattgctagcactaaaatactatttatgccgttttttcctgtttcctaattttttatgttactttttatacatggcatttttgttactgtcctcaactcctccatgttctgacagattgacacatagagacagaaaatgacttttccagctttattgccatataattggcaaataaaattatacatctttgaggtatacaacatggtgtttttaaaatttattttaattgaaaaatgacaaatcgtatatacatatgtgtgaagttttgatatatgtatacattgtagaaatattaaatcaagctaagtcacatattcatatcatacatatacttatttttgtgatgagaacatttaaagtttgttctcttagcaattttcaagtatactacagattattattaataataatcaccatattatatctccagatacttattcctcctgtctaaaacttttatttttgagacagggtctcactgccacccaggctgaagtacagtggcacaatggtagctcactgtaacctcaaactcctgaactcaagtgatccccccgtatcagccccccaggtagctaggactacaggcatgcaccaccacacctggatcatatttttttagaatcagggtctcactatgttgcccagtctggtataaaatgcctgccctcaagtgaacctccctcggcatccaaaagtgctgggattttagtcatgagccattctgaccagcctaaactaaaactttgtaccctttaaccagcatctacccattccctgacatccctccccacccagcccctggtaaccaccattctattatctgattctaggagtttgattgctttttcagatttcatgtataagggagataatgcagtacttgtcctccaggaccttccatgttattgcaaatgacaggattttcttttttaaggctgcatagtattccactgtatatatacataccacagtttcttccatccatagatgaacacttaggtcaatcccattcatccacagataaatacatagcttgattccatattttggctcttgtgaatagtgctgcaatgaacataggagtgtagatatctcttaaacatactgatttcatttcctttggatataaacccagaagtggaaattgctgaatgatacggtagtgctatttttaattttttgagatacttccatactgtttgccataatgacattcccaccaacagagtatagacgctctctttcttccacatcctggcctacacttgttatccctttgtgtgtgtgtgtgtgtgtgtgtgtgtgtgtgtgtgtgtgtgttagcaaaagccattctaacaagtgtaaggtgatatttcattttagttttgatttgcctttccctgatgattagtgatgtcgagaatgtttcatatacctgttatttgtatatcttctttggaaaagtgtctattcaagtccttggcccattttttaaacatcaggttatttgtgtttttgctataaaattgttttagttccttatatatttaggatattagtcccttatcagataaatggtttgcaaatattttctcccattctgtagtttgcctcttcactctgttgactgtaaatctttgccactttgtatatccagaatggtattttccaggtaaactttcaggatttctacagttttcagttttacatttaagtctttaatccatattgactttatgtttgcttatggtatagggaaagggtccagtttcaatcttttgtatatggctagccagttatcccagcaccattcattgaatagggagtcatttccccattgcttttttgtgttgactttgctgaagatcacacagttgaaggtacgcagccttatttctgggttctctattctgttccattaatctatgtgtctgttttgtaccagtaccatgctgttttgcttacagtaggcttataatatagtttgaagtcaggcaatgtgatgcttccagcttgttctttttgcttacgattgtcttggatattcaatctcttttttggttctatatgaattgtaaaacagttttttctaattctgtgaagaatgtcattagtggtttgataggaatagtattgaatttgtaaattttttaggggagtatggacattttaacaatattgattcttcctatccatgaggatgaagtgttttttgatttatttgtgtcatctctgatttcattgagcaatgttttttatcccattgtagaaatcttgcacctctctggttaggtgtattcctaggtattttattctttttgtggctaatgtgaatggaactgcattcttgatttggttctcagcttgggtgttgctggtgtataagaatgctagtgatttttgtacattgattttgtatcctgaaaaaatatagcttttttatcagatgaagttgtttatcagatcaaggagtttggggttttctaggcatagaatcatatcatccgcaaacagggatatttgacttcctctcttcctatttggataccttttctttctttctcctgcctgattggtctggccaggttttccactactatgttaaataggagtggtgaaagagggcatccttgccttgctgaggttttcaaaggtatgtctccagcttttgcccactcagtattacgttggctgtgggtttctcatagatggctcttattattttgaagtatgttcctttaatgcctagtttgttgagggtttttaacatgaagagatgttggattttatcaaaagccttttctgcagctattgagatgatcctgtgggttttgtctttagttctgtttatgtgatgaattgcatttattgatttgcatatgttgagtcaaccttgcatcccagggataaagtatacttgattgtggtgaattagctttttgatgtgctgctgaatttggtttcctagtattttgttgaagatttttgtatcaatgtttatcaaggatattggcctgaagcttactttttttgtcgtgtctctgtaaggttttggtatcagtatgatgctaacctcacaggatgagttaaggaggagtccctcctcctcaattttttggaacagcttcagtaggaatagtagcagctcttctttacacatctgctagaattaggctgtggatccctctggtcctggggtttttttggttggtaggctttttattactgatttaattatgtaactcattattggtttgttcagggattcagttacttcctggttcagtattgggaagtattcttgtatggtttttcgcatctcaatttccttcagttccgttctacttttggttatttcttgtcttctgctagctttggagttggtttgctcatttctctggttgctctagttgtactattaggtggttaacttgagatctttctaactttctgatatgagtgctaagcattatgaacttcactcttaacactgcctttgctatatcccagagattctggtacattttatctttaatctcattaaagaatttcttgatttctgcctaaattgcattatttacccaaaagtcattcaggatcaggttgtttaatttccatgtaattatatggctgtcagcgattttcttagtattaatttctatttttaatgcactgtggtccaagagtgtagctggtataattttgctttttttatttgctgaggattgttttgtgtccaattgtgtgcttggttttagagtatgtgccatgtgcagatgagaagaatatatattctgttgttttgggtagagtgttatgtagatgttatacatgcatttggtcaagtgtcaaatttgagttctgaatatctttgttagttttctcccttgatgatctgacatttgactaatactgtcagtggggtattgaagtctctcatcattattctgtggttgtctaagtcttttcataggtctctaagaatttgctttatgagtctgggtgctcctgtattgggtgcatatatatttaggataattaggttttcttgctgaattgagcagtttaccattatgcaatgtccttctttgtcttttttgatatttgttgatttaaaggctgttttgtctgaaattagaatagcaacccctgcttttttctgttttccatttgcttggtatatttctctccatctctttactttgagcctatgggtgtcactgcctctgagatgtgtctctcaaagacagcataccattgggtcttgcctctttatccaacttgcctttatccaactctgtgccttttaattagggcattttgcccatttacattcaaggttagtattgatatgtgcttatttgatcctgtcatcatgttgttagctggttattatgcagacttgtttgtgtggttgctttattgtgtcattggcctgtgtacttaagtgtgtttttgtagtggctgttaacggtctatccttcccatgtttaggactctcttcagaacctcttataaggtaggtctggtggtaatgaaatcgcttagcatttgcttgtctgaaaaggatcttatttctcctttgcttataaagcttagtttgctgggacataaaactcttggctgaaaattcttttccttaagaatgctgaatataggcccccaatgtcttctgatttgtacggtttcttctgagaggtctgctgttaccctgatgggcttcactttgtaggtgacgtgccccttctctctagctgtctttaatattttttttatttcgaccttggagaatctgataactatgtgtcttggggatggtcttcttgtggagtactttgcaaaggttctctgcatttcctgaatttaaatgttggtctctctagcaaggttggggaaatttttatgaatgataacccaaaggatattttccaagctacttgctttctttccctttcagggacaccaataagtcatagatttggtctcttcacataatcccgtatttctctgaagttgttttcattttacttttttttttctttatttttgtctgactgagttatttcagatagctgttcttcaagttctgatattctttcctcagcctggttgattctactgttaacacttgtgattgtattctgaaattcgtgaagtgagttgtccagctctatcaggtaagtttggttcttcgttaaaatggcattttcatatttcatatcctatattattttattttattccttataatccttggattgggtttcaacattcccctgaatctcaatcatcttcgttcctattcatagtctaaattctacttctaccatttcagcctggttaagaaccattgctggagaactagtgtgggtgtctgtaggtaagaagacactctggctttttgagttgccagagttcttgctctggttctttctcatctgtgtgggctcatgtcccttcaacctttgaagttgctgtcctttggatggtggggtttttgttttgttttgttttttgcttttatctccattgatgtccttgggggtttgtggcataaggtggggtccatcgactggcttcatttctagtagattttgaggagccaaggctcagctcaacactcccacactgtatactctaactctaaggggctggtatcgggtcactggctttgttctctggtccctcaaagttgggacctgctgtgttaaatgggccaaagtgttcctggtccgatggccacaacactccaacgagtggtgccagccaaagcgcttcatcaggcagtggcaatgtgattaatgcttgtttgcatgtgccagcagcagtggtagtacaccagggttcacccttgttagctggggtggggcgctggcagaccagcaactgccagcctctgtatgcgcattcacagtggcagcagtggcaccatggaggggaggggtcactggcatctgtgtgtgcattcacactggtgggcagtgttggcatagcagtggatttctggctggggtggggctggcaaactccttgtgcatgttcacactggtggcaatcgtggtgggaggcagggccactggccttcctgagtgctttcacaccagaaatggcagcactgcaacacagcagcaagtgggggacgggtacactcacgctggcagcaatggcgcagtgggatgcacgcacatcactgcaccagcatggaagggcaaggttcacccatgcacacatgtgccaatatggcaataggaggatggccttgggtgagtgcttgctggtaaagcagcatgggggaggctgcagtagagggagagtgtgagtgggccagtgcatgtcagtgggggccactctgctggagctctctggcaatctggcacagtctgccagcacaggagctatgatgagggccctagggaggcatcctggttgagcatctgagtctgcactgtaagcaggcaaagccaggctatggtcccaggagaggccagccgatgggagagttcaggtaagactggccccatctgctctgttcaggttcaacaattcttttaaggctaaagtctcctagaggaacatggccagcctgagggaatgggcatccccggccatgcccccctgcaaacattccctcatcaaaactctctgggctctgtacaggctggagtcctgccccaaccatctctctaagcaactctctctgccagctcaagtgtgggggtcatggggtcttctgctgccaggattccagaggtccaaagcaagagcagctcactccttgcctgctcaactcacccattccccaggagacattaggagccaggaagaagacccagtgtgtggcagccccatgcaggattcccagcttcctcccctttcagcccagtgtctctgtcctccctctgtccactctcagtaactttcctctgaagatcgacttggaatgtgccagtcttcccaatgtcctacccccttggtggcagatattctttctagctgcatctagtcagccatcatttcccacatttattgatttacctatcttgagcaatccttgcatcccaacaataaacccacttggtcatggtgcctgatcacttaatgtgctgttgaatttggtttgctggtattttgtcaaggacatcgtctttggaaacagattttaattacactaatgatgccataaatatttcacaattatttttaacctacatccctctaatatttagcaagttaaaaattaatacctctgccctgttaaaataatagcttggcatatgtttacttctccctctcctagtcattttggttttcttttatataatcttgagatgctgaggcagatagtggttttaaattgttttaacttcacataccttctttttcaagattctcttctgacatttccattgtttatattgtgtacacaataaatatttaaattcatctctattttaattttggcattcaccagtactttttcgttcttgagtattttttttgtttgatttgatcttttgcttatccttaggctgattaaagtccatcatccagtaattttatttttcaaaaagaatatcctagtgatatatcttctgaggctttgcacattcaaaaatgtcattctgttgcctttacacatgaaggaaattgtaggtataagattcttaggtcacaacactttggcctaaaacacagcacacgttaagtttctctattgttttatgacatttaggtttgcaaataagaagactaaagtcatctaaactttgctttcccctccccctggggtctggacatttataaaaatcattctctttgtactgtaattcaaacattttttaatcttgtattgagttttagctgataaagagtgaaatctttaaaattacatacacagaccttctgaaaagttttctcatatctttagttatttttgtgttattttattctgagccttccttcagaaatatcagttgttatatactggttttctattttctgccttaatatcaccttcctcaaaatttttgattctttgtccctttcttttgcagtctgaaaggtcattatgccttgccttcatatcgctgatttaattctttacaaaatctgacctaacccaaccagcaactatgtgatcgtaagtctgctattgtacttttggtttccttacgatttccttatgacaattttcacttcatccctttctttccttatggtgtctgttcctccttcatagatatcatatcttcttgtatgctactggtgaatttttaaacattttcttccggagtaacacattttcaggagaaactccttcctctgaatcttctgtgtaatgctctcattcctttcctctacaatgctttcccacagactccattttggttctgttctcctactcattcttgaacaccgtacaccactcagacttggtgcttgatattcagaacaccattcagtttgctgcttgacaaaaaccacaggggctgtaactgtgcttctattacgtgtctctaagtgtgatctctctctcagagatacagctaaaaccaattcccaggagggtttgaactaggttacactgctctactgaggaggcacgtttctcctcaagccacagcctgcttcactggtactctaaaatgatatgttacacagcctgcttcactggtactctaaaatgatatgttatacagcctgcttcactggtactctaaaatgatatgttacatgggaaaccaacaaggaattgctatcagagttgctgacaagtcaataagtattttgcaaattggcactgtgcctccaatgtaccatgtaccagtagtttcccctctatttactgttgattttttttttctgggactcagaactgccacataaaagcacagttgagatttacgcctttaaatgggaagcttcaaaaaattaacaatttttgagaaaaatctatctctaaaattatacgatgattacgagtccaagctcataatcagatggcatggatttgtgtccctgttccttcacaaactacataacattctgtgcctcagttggctcctctgaaaaactgggataacaatgagtatatcaaagaattgtgataagttaataaattacttgatgtaaagaccttagaacaatattaggaacataataaatgatcagtatatgtgaaacattattattacttcctcagattgaataactcaaggttattgtgaacacccaaaatcacaatgtgccacaatacagtaattcccttagtctgtctaccttttcagaaagtagtacctgaattgccaattttgtctttttgtaactgctttttatcattaattattgaatcttcacctctgacaagttcttagctgccatttcttgacactggtcagtgtgctagcacaagcaccttgatctaatttattgcttctaaaattattagaatgaaattatctgggtgggaaaataagggactcccctctgaggtaaacatcaatgtgtcaatgaccatacttttgagctgggggtttcttaaggtagaagctgtttctcatttttatatccctaggacccaggataatatctagcccatactccaatagtcaataagtattgttttaaatttgttttttcttaattgaatatatctgtattgtttaagagcctttttggattgcatttttagtttttacctatattccagacagctgtgggtgacataagtaaacaccagaaaagtgagagataattgcatacagatcttggcaaaagagaacagatcaatacttttggtgggttaaaaaaaaaatccttgtttgtgctgggcgcagtcgctcacacctgcaattcctgcactttgggaggctgaggcgggcagatcacgaggtcaggagattgataccatcctggctaacatggtgaaagccccgtctctactaaaaatagaaaaatcagccaggcatggtggcacatgcctgtgatcccagctacttgagaggctgaggcaggagaatctcttgaacccgagaggcagagactgcagtgagctgagattgtgccactgcacttcagcctgggcaacagagcaagactctgtctcaaaaaaaaaaaaaaaatccttgtttgtacctaaaagaaaattaaagaacaaacaacctagaaagagataatgctatttccaccccttcctttttaatgtacaaatggtagtaagcaataaatgatttgcttgtaatcctttccccactttaaattgttaataccagaaaagtatttaaaagtgataggtaatgacaacacaaaccagatagtcaaggatacataatatattttcaaacatgagaatttgctataaataattgatttaagtagccataagcacatttattgaatattcactgaatatattttttttgctcccttgcatcccaagaatttaggtaatcacaaaaggaatattgtgtagataagaaagagattgtgctatatatcagaaactagatatactgtggcagacaccatagcatagtaaagtgcacagaggaggtactgacccaaacactgactagctgaataactccacaatgcttcttaactgctatgacctctgcttcccaatatgaaaaataagggtgattagattgcataacttctataaatcttttcactgcacaatttcatggtttaaaacatcactaaaggcacacgtactcttaaaaatcatgtcagtggtagttcaaaaatactatccaatatgttaaatatacggctgtgactattttaaacatgatttaaaaagcgtgcatgattgctaggcattggaataactatattttaaggattgtgaactccattagacttcgtatctcatttgttaaacagttccatcagaatgattttaagtagatatttcaattcagtacattttagaacgtaggtgcttaacatatgtctggcatgtttctctaggtaaacagcaccatcttttactctctggaactgtttggaaaacaagcaataggttatctgtagggggcaggtgtttccttgctagtcaaatcatttagtctaaccatttcctgatttaacagatgaggacaattcatcaacaatgacatttcggtttactacttattatttgtttgatgttcaaagatcttaagagcagacaatagccactagagatcaataaagaccattacataatatgtgtgtgcttaaattagggacagcatctgatgctgtttcttttacctcaaagacaagttagaatcctatgctcctgtcctgctgctgtctcataggcaggataaaataatgtcattcagatggcatttcctccccctgaagagatatttagaactaagttttataccaaaagttattgaatgtgcacacctgtaacactaacaacaacaacaacaacaaaaaagccctatacatcccatttagctctacaattacatagtccagagctacggaagatttatgtcaggtcttcgagctatcaaaaaggatattccctgagagggatataagacatcaaaactccaaggcttgagatcacagcaggtttaataaagaaagaaaaacagatgtcaatgtaaaagggggagattatgaaattaattgtaaaataaaaagtggcatgctgagcaacattttcttccaatgtaaataatgttaggaacatatgcaatatgaacaatgatggctatttttcttttaaagattgttattattttaaacaaatcttagttacagtgaaaacaactaatatacattaacaagtaacgttattaaaaagctaggccaattgataccgcatggaaagggaatcactgtagttatgacacctaataaaaaggatttaggtctgctccttgaagtgaaatagaataggaatggtcagcaggctactggatacagatgaactgagctccaatattccctttctagtgtacattcaccagggagggagactgatagcagaaaccttagtttacttcgaggctaaatacccaagaaaagataatggtagaagaaagatttcctttctaggtctatctctatgtgcgtaacagtcctcagcaggatgtaatgaagtttgggataggaataccttattttacaaatagccagtgcatccctttctcctcactacagcctgtctgtctcacaggtacatacataccaggatatcaggaagagggcttaccagactgcaacagagcaggaagccaggaagctcttccttaatggatggacagccagtgatctgcccaaagaatgaacggtggacaaacaatacacctaaaggatactgatgccttatacaggaagcaaggattatgaaaaagtatgtccatttcatatgaaatatacttaacattttgtattgagctgcattaaaactgcaacaataaggaaatttattatgatttaaaagagcactcatgcaggtcaatacgtgttgctagaaacacttttccaaatgacagaaacagatttcttcctatacactaagctcatgaagggcagaatctatgtctaattcatcctcaaccccaccccagtacctaatataataccttccccaatataaccatttaatgggtatctgctgagtgactatatggataaacaagatggtggtattacaaagtgttttttaacattttgtgatataaaccatatgtaattttaacttgtatgtattctaaatagtttaaaggttaacttttttcattttctattatttttgtattttacaagtagattgacttgataaatgttaaaacagcagatagtgacaaaagcagcaacaaacatttgccatttaactactcttttactttctatatcttatagcaaaaaagaatttagaaacttaagtttcatagtcagaaatctatagaactctgtttttcccgagatggtggaccagaggcctttccaacgtgcctcatctacttggaagaattttgtccaagaaggaaatgaaaaatcaacagaaagtgaaagaaaacttcagatactggggaagagaaggtgagcagggagacagtggctaggtctggttgagaactgagtgaagctccaatataggagaggggaagagaatgtccctctgcaatctacctgtctactgaggaactgtgcaacctaggccatggggaacaccctatccctcccaagccctggatataactaggagagaggccaggagcgtgtgaaaaggaatgataccaggaagtaccccaggcattgtcccagacctgggacccaacaggacaatgccattcttgattctaactcatatcaagctcggcgggtccctgaaatctagcagtggcggcagcaccagcattagtcttgggccaggatttggagtgctggatctggagcaggggaagagcccccacagccagaacttagaggtaagtgtggtgtgcaatccagctgtgggtgctagaattgggatacccctccttcatagaccgaaataggaggagagttgctgaagaggcatggttttgcctgggtagcaggttttgtggccacaggcagctttgaaaaataaagtaaaaaaactgcacgtaacatttctgagtgttgcaactggctcccttgcttggaataggggtgtgagccccctcaggtctgaagagtgagaggtgggtccccctcctgatcacctggagtaggcatgtgggacacccatcacttcccatgcagagaacttggtgcagcagtggttgctctgtttcttgcccagccttatctccagccacctgctgactacctctagacccctgtcagggctggtgcttgtgcctactgttgggagatgtgaatgcagacttgcccagtccagctctgcccagatttggcctccactgagactgagcacaggacccagtccactgaatattccatggcccagccattgtctgggcaatgaagtacttctcatggttaacaaaggtcaagcataaactttattcctacaagagcaactggcgtttttacctgcaagtgccacctactggtctggaggttgacctgcaaaccccatagtaaatctgctgacacaaatgcacagtgcttgggaataacgtaagattcccacgccccttgctaccacaatcatcaatgccactgtggcttctcaggaggctgtgagcctgcttaccttccaggtacaccactactacaaccagtatttgagaaagccaccacactaagtctatttataaccaaggaaatcatacaaagccttaacattcaacatacccagaagtaaacagctctacccaacatacttcatagttatatccgcaagaaaaaaagttacatttcaatgaaattcaaaactaagaagttactatttctccagatgtgaataaatcaccataataataccagaagtatgaaaaagcagggtagtatagcacccacaaaggaacacagtaattttctagcaatggatcttaccaaaataaaatttttgaaatgctagataaaggccaggcacagtggctcatgcctgtaatcccagcactttgggaggctgaggtgggcagatcacaaggtcaggagatcaagaccaccctagctaacatggtgaaacccgtctctactaaaaatacaaaaaaaattagccaggtattgtggcaggcacctgtagtcccagctactcaggaggctgaggcaggagaagggcatgaacctgggaggcagagcttgcagtgagccgagatcgtgccactgcactccagcctggatgacagaacgagactccgcctcaagaaaaaaaaaaaaaaaaagaaatgccagataaagaagtaaaaatactgattttaaagagattcaatgagataaaagatattctgaaaaccagcacaaagacatcacaaaatcaattcaggatataaattttaaaaacttgccaatgagacagatatcttagaaaaaaataatttctggaaatgaataattaagaaattacaaaatacagttgaaagcttcaacaattgactggaccaagcagaaaagaaaattctcagaaattgaagacaagacttttgaattaatccagttaaacaaaaataaactaaaaataaattttaaaaaaatgaacaaagcctttgagaagtatgggactacataaagcaactgaagttacaaaagattgccattcctgaaagagaagaaaaagcaaaaagtttagaaaacctatttaaggaaataattgacaaaaacttctgtagtctagcaagagatttaaacatccacatacaagaagtgcaacaaacactagaaaaagatattgcaagatgcagtttaccataagaaatagtcatcagatgttgtctaaagtcaacatgaagaaaaaaatcctaaactcagcaagacaaaagcatctagtcacctattaagaaaaaaaacatcagactaacatcagacttctcagcacaaaccttttccaaaccagaagagattgggatccgatcttcagagtgcttaaaaagaaactgtcaaccacaaattttatatcctgacataacaagcttcataaatgaaagaaatacaaagtatttcccagacaagcaaatactgagggaatttgtcactattaggctggttctataataaatgctcaaaggagttctaaacatgtaaatgaaaggtcagtattcaccaccataaaaacacatttaagtataaaactcacaggtcttacaaagcaattgcacaaaggaggaagagaaagaaattaaatagcaacatgacaaaactccaccaacccacaaagagaaaaaagaaacaaataatttagaaaacaactagataacattataacaagaaaaaaactcacatatgaatattagccttgaatgcaaatggaatgaatgctctacttaaaaggtaaagattgacaaaattgatttttaaaagcatgaacaaaaaaagtaaagaccaatatccctgatgaacatatatgcaaaaatccataataaaatactaagaaatcaagtccaacagcacatcaaaaacataatacaccatgatcaagtgggttttactccagggaggcaaggatgattcagcatatgcaaatcaataaatgtgattcatcacataaactgaattaatggcaaaaaccatatgaccgtctcaacagatgcagaaaaagcatttgttaaaactgaccgcaccctaatgataaaaaccttcaacaaattaggcatagaaggaatacacttcaaaatattaaaggatctgtaaggcaaacccacagccaacatcacgataaacagggaaaagttgaaagtaatcccaataagaactggaataagacaaggatgcttactttcaccatgcctattcaacatagaactagaagtcttagccagagcaatcaagcaagaaaaagaaataaaagccatccaaatagaaaaagaggaagtcaaattatctgttattgataatatgatcttatacctaaaaaaccctaacaatttctccccccaaaaacctcttaaatattaaaactgaattcagtaaattttaggatacaaaatcaatgtataaaaatcagtagtatttctatgtatcaaaaacaagctgagaaccaaatcaagaagcaatcccatttacaatagttataaaaaaaacctaagaatatatttaaccaaggaggtaaaaggaaaactacaaaacactgttgaaagaagttgtagatgacacaaacaaatggaaaaacatctcatgctcacggattagaataattaatattgttaaaatgaccatactgcacaaagcaatctaagattcaatgcaatccctaccaaaataccaatataatttttctcagacttagaaaaaacaatcctcaaattcatatggcattaaaaaagagccagaagagccaaagcagtccaaagcaaaaagaacaacactggaagcataacattatttgacctcagattatactacaaggttatagtaactaaaacagcatggaactggcataaaaatagatcagtagaacagaatacagaacccagaaacaccaccacataactacagccaaatgatctttgacaaagtcaacaaaaacatatactgggggaaggacacccttttcaataaatggtgctcagcaaattgaattaccatatgcagaagaatgaaactgaatccctctctcaccatatataaaaatcaactcaagatggatcaaagaattaaatgtaggacttgaaaccctacaaatactggaagaaaacctagggaaaactcttctggacattggtctaatcaaagaattcatgactaagacctcaaaagcacaagcaacaaaaacagacaaatgggatttaattttaaaaaagcttctagaaagcaaggtaaataatcaatagagtgaaaagacaaccgtaagaataggagaacatatttgcaaactatgcatctggcccggggactgatatccagaatttacaaggaactcaaacaactcaacaacagcaacagcaacaaaataataataataattaataaccccattataaagtggacaaagggcatgagtagacatttttcaaaaaaagacacacaaaaggccaacagacctatgaaaaaatgcttaacatcactgaatattagagaaatgcatattaaaaccacaatgagatatcatcttattctagtcagaatggctattattaacaagtcaaaaaataacagatgttggtgaggatgcagagaaaggaaacactaacactctgctggtgggaatgtaaattagtataatctccaaggaaaacagtatagagacttctcaaagaactaaaaataaaactaccatctgatccagcaattccacttctgggtatctacccaaaggaaaaggtcattattcataggtttctcacagcatgattcacaatagcaaaacatggaatcaacttaagtgcccataaatggatgactggataaagaaaatgtggcatacacacacacacacacacacacacacacatatatagatatatatagaccacacacacacacaccccatttgtatgtacattatcttaaatgaaacaactcagaaagggaaagtcaaatgccacgttcttatttataagtggaagctatataatgggtacacatgaacgtagagtgtggagagtgtggaatgacagacactgaagacttggaagggtgggaggttaggaggggacgagggatgagaaattacttaatgggtacattatttgggtaatggttacactaaaagcccagacttcatgattatgtaatatatccatgtaaaaaaactgcgcttgtacccgttacattcacacaaaaattttaaaaataaatctataaaactctgcactttactgcctaaggtattaagtgtgtcaataaccccctagttattacaggagggatatcaacatgtgtcagttgaaatagtactataaacaacaaggaacaattgctaatctttttcaagtagtagtcagtactttcattgttttaggttcttttgttaaaatgtttaaagttcttgttgcacatatgacacaacagaataccaaatacatcccattgattgtgtagttttaaactagtagaaagaaaatataatttcaacatgttataatgagaggttaagataataatacagttgtcccccagcatccatggggaattggtgccagggcccctttaggataccaaaatccatggatgctcaagtcccttttataaaatggtgtagtatttgcatataacctacacacatcctcctatgtactttaagtcatctcataataacttatatagtacctaatccaatgcttacacatcacttcattcacatggattcaacatagtacttgacacatggcaaatccaagttatagttttggacctttgtgtaattttttttcctgaatatttttgatccatgtttgactgaatccacagatgtgaaatccatggatatgaaaggccaactgtactcttcactcattaaatataacacacaagcagtgttttaatgttgatataactaataattgaactgaagcagttgtttattatataaacaggaaaaataagcaaaatttaattactggttagctgaaattaacttagaaacaaattattcttggctgggcgcaatggctcatgcctggaatcccagcactttgggaggccgagacgggcggatcacttgaggccaggaattccagaccaacctggccaaaatggtgaaactccctctccactaaaaatgcaaaaattggctaggcatggtggtgcacacctgtagtcccagctactcaagaggctgaggcatgagaatcccttgaacctaggaggcagaagctacagtgagccgagatcgtgccactgcactccagcctgggtgacagagcaagactctgtctaaaaaaaaagacaaagaaacaagttgttctttaaaggtgagaatgtatggtttcataaaaatcagtctgcattaatgcctcatttgctattttaaatattttatagcttccataaaacatattacctttttttcatagatgtgttttaaatgacttttctccatctgaaacttattttcttgatcctgtgaatgataaatgtttatatttattatactttaaattatactagagtcaataaaattagcaacctaattaaatcaatcaatctacttaatgtcaaacttcagttcagagttttgcatatgattaagtaagccctacaggtagaaattggagtagctttgtattacgaggcataaaatcttagtcacctgaagatattactattctcaaaagcacttgctttacagtataagaaaatctttctgacccttaggattaagagattacttcaaaaatgaccaagtcaataaatatggaaatgataaatttgaagttacatcatgtaacagtccttggtattttttgatcacgagagaaaagagatctaaaaggtgcaaaagagagagacagagggagagagagaggcagagaaagaaagagggaaagaaagagagaaattatgaagattggcaggtaatttaaaagaaggaaattattctaaaataatgatatatttaaataaaatttatttttaaaactaatctcaaaagagatcattccaattcaaattattgtactttattctctacatctcaaagcatcaatctctattaagataaataaaatgtaaaattatacaatgcgataaaagaatcagaaaagatgacctgcatttctgagttttatttttttaattgactctcaatgatacatctgaatcaagaaaactgtgtttgaccattgttcttctgtgtagaaatacaagactcacccttagttgttgctttctttgaagttctgattcctgtaactgctgttttaattgacagacattctgctctaattcttcaatcatactagatgcctacaaggattttaagaagaataaaaagcagaatattgatttttgtaccatattatactttctgattgaaaaaatatgccttttgtacccctgaaagtccaatcagaattaaaattatctagaaatttgaatgaaaaatgtttttaaaagatactagaaaaaataatcttttaaagtaaaaatataaattaaatgcagcatagtattaaatattatgaaaatgtaatgctgacataaaaatataatcttttaaagtaaaaatagaaattaaatgctacataatatttaatgttatggaaatgtaacactgacataaaaataatagctttacagaaaacttcaaaattttaattataaaatgaaagcagaaccaagatttcaaaacaataataacgcatatagttactctatgaaatgtattattcatacaactaagcattggaatttatatgtttcctccttttaagactggcacttaaaatgattagcttatagcagaattcagtttattaaatatttgtgttgtgctatatagtagacatttcgaattttaaacattttaaataccagtaaaaattcctgaagttcctgttaatttaagaataaagtgaaagagagattaatttcaaatgccaaataatttctacttggctatctatggctctaggcttagtgaataaatacttcatgtggattatctattaacataaataataccttagaagctgaaagagcatgttcttgttttagaaggtttatatcagcatcatatttggtttgtaacagtttcatgttttgctcataatcatttacaagatggtccttctctttatgcagtgtgttacgcctaaaaacaagagaataaaatagactttcaatgtatttaaaaccaatctctaaaatgaaattttttaatcagctaaatccaaatacatttccattcaatatattaaataagtatccacaattttgtcaactgcttctaaacattctgcttatgttaaaaacaggttgggtacagtgactcatgcctgaaatttcagcacttgaggaggccaaggcaagaggatcacttcagaaaaagagtttgagaccagcctgggcaacagagtgagaccgtgtctctacaaaaaaataaaaatagaaaaattagccaggcatggtggtgcatgcctgcagtcctggctacttgggaggatgaggagggagaatcgtatgagcccaggagtttgagatacagtgagccatgatcacaccactgtaccccagtctgggtgacagacagagaccctgtctctaaataaacaaacaaacaaacaaacaaacaaacaaacagcagtatttagattagaaacttcccaaggctaaacgcacaaggtgtaattaattttggcagataactgatacagttaatatcagtactttatagctacacctgataaatatctgatttcagacaataccttgcctttacttcttgtaattcactacacgttatctggtaacatctttcaagttctgctttttcttgaattaatttctgcctctgtaaattactgttctctgcttctccagtcagctgctggacacgggcctccagttctttgatcatgtggttctaaaagaacaggtcatggttaagaaagtctctgactcagttgtaacacttttgtatctgtaagaagcttgaggaacacgtataatctataagaataaataaaacaaatgtatcataaaccatggtagtagaaattaaatcaaccttgaacttaaccaagtctttaaaaaaacaatgcatactaccagaaaaataagaacatcacagttatatacttttagccttttgttcatttaatgaatatttactgaggctggtaatattcaagaatgtagatacatagcagtaaataagacaaagttcctatcctcaggaaggtttcagtctctatgcctctttatacgtacggccattagctgactacttaccagtgatctttgcgtttgattttaagtttttgaaatgtgttataagagtaatgtaatagtatttttaaaggaaatccatagccccaaaattgtagcacaagggtgttcacataagtgatacacttatttttaagtgtataggaacatttaattagttgtgttagtgtgcaagatttttattcattttttaacatctttgccgttttgtaaaatgcacttctctactcttccacagtattaagattatcactcaactaaatcatttctctattatttaatatttatttagaatttttcccctttgtagaactgcaatttaaaacgtggataaaggtatttatcatcttttagatactttatctaaaattagggtaagcaagcattagatgaagggacagttaattttcagttttaaaattaaacttctaataagtgtgagcaataaggataggttagtatgatgttgcactcaactattgtgttattctaagagaaccattttaaagatgcagtttaagcattagataatattacaaccctgacatcctttcttcatctcatcctttcttcattacaataccaaataggtatacaagttaaattttggtgtaacagcttccaatctatataaatgacttatctaacttaaaagcatggtttatagactaacttctttaaatgcatacaattctagactgacaaacatcagaagttctgatttcttcttcctgcatcttattcactttgtctcttcattatccctctgctttaggagctcctttcagaaaatagtttccatttcctaatatatattctaaacaccctttatgtcctgcgtattcattaactggaagaaacaaagaacatatactttgccttccagttttagatggcggaataaagatgatttgtattccttcgtctcttggaaaccaaaaacagacaagataaactaaaaatagaaatgcaaattccatactaataaaccctacaagaggatattctattattggcaataaaagagtagcttgcagcagatcacaatcccaatgctaacaactgaaaaacccagttttgttttgttttttttttttgtttttttttttttttgagacagggtctcatagcgcaatcttggcttactacagcctcaacctcccaggctcaggtgatcctcccacctcagcttcctgagcagctgagactacaggtacatgccaccacacctggctaatttttgtaccttttttggtagcgatggggtctcactatgttggccaggctggtttcaaacccctggcctcatgcaattcacccttctcagcctcccaaagtgctaggattacaggcgtgtgccaccatggccagtgaaagatttaattagtaggaaagcacttgagaacttctaaggcagtttgaaaacatcatagagatgaggcatcatcctgtaaggtgcttttaccctagaggtatttttcaatgacggaagatgaggatggggcaaggaaacaaaggcagatggtggccgaggcagccaggacttgaggacacaagatccctcagaaaagcaacacacagagaagtgggcaccacaccagcagttttctcaagagaatttgtcaaattctttttctttttctttttggagatggagttgcactctgtccaggctggatctcggctcactgcaacctccacctcccaggttcaagcaattctcctgcctcagccatctgagtattggaattacaggtgcacaccaccacacctggctagtttttgtaattttagtagaggtggggtttcaccctgttggccaggctggtcttgacctcctgacctcaagtgatctgcccaccttggcctcccaaagtgctggcgttacaggcatgagccactgcacctggccaaatttgtcaaagtcttagcattcacagggcaggaagccaagaaaccaagtgaaaaaaaaaaaaaaaactcagaaaagcacactagagttttctgcagtatcagtgtacttaggagtaaaatagattgtccaaggaggagagcccctagtattaataatatcacaggctttcagttgagacctgtgttgaggactaccactaggagcgaaagttagtcaaaagtagaccaaagattaccaagattgcaactcagccttgagtcaattcagtccctgaatggatccagtgatctgtctctacaccagctgcctctcagaagtgagagaagagcctctctggaagaagataacatcatccacagcctttattattttttgtgcacaatgtttggcaattaatcacaaaataacaggcataccaagaaataaaatcagaggaaaaatagaaatagacatgcagatgccccatatattgaaattgtaaaacatatgaggcatgtgttttcctgactcaaaatatatgagacatcacacaaaattaagtgaagatcaaatataattacaggaatagtccagaagaagaagtctcgtggctggaaatcctgaaaatgtcatcagaacacacttgtacaaactaagtggcatgcaaataacatcgctggttcaataataacagatgcatacattccaactgtagcttctttcaacataatctggcacgaaaaagaagcaagaaagattatgctgaatgaaaaaaatcacacaaaccatttttgcacaaagcaatctatggatgagattgattaagggaaagaaataacattatgagcaagtaaaaactgtaagagcaaacaaccaacatagaagaaaacaaaatggagatccagcatttacctagttagtgtacctaaagaacagaaatggtagaacaagaaaatgtacctaatgacatacaagaaaactatacatgaaaataatatacaaatagagtatactgtaaaagtcacacagaatgaagaatgccaagacataagtaaaattattaaacttcaaggaaatgatccttttaaagcattaatcagacctgtcactctcttgcaaaaccctccaatggcttctcttatcactcagaataagaagagactatcatggcctctgatttcatctcctaccaccctccctctcatttactatactccagccatacaggcctccatgctgtttctcaaagtcatcaagctagcctcaaagccttttcatttactgttctctctgcctaaagcatcttcctccaggggcctgcatagctcatttcctcacttctttcagttctccacctaaatgtcatcttgtgaaggaatctttccatagccattctacctaaataagcagatctctactgcctatatttctgtggcctcttaccctttcttttgctttttctttctttgttgtttgttttccacaataaagtataagcttaagacagccaagacattgctttatttgcactagatctcctgtttctttctagcacactgcttagcttgtagtaggtattcaataaacatttgccaattatcaaaacagctgaccttgaatgatatgggtttgaactgtatgggtccatttatatgcagatttttttttcaactaaatggtgatcaaaaatacaatattcacaggatgtgagacccacttacatgaagggtccgctttttctgtacccagactccacaatgccgattgcaagacttgaatgtgtgccaattttgatatacacagaggtcctggaaccaatcccctgcatataccaaggcactactgtattctcaaaaataaaaacaggataactgctaaaatgtcaaaatgtcccttccatattcaaaactggagtgatttctggccatattatagaaaatattagcattttataaggttataacagggttacaatgaggaaataacaaacatctgtccaatatagaatatatcaaaatgatttttgcatgttttataaaaaatagagataaaatacaagaaatccaacatagaggtaaagatattcccctctatattaaaagaatttctggaaatctatttctttttttccttatatgaatccaaaataaatgtgaacatcataaaattttagaaagtatcaaattgctaaagaaataaaccaaggcaaagggggttgaattacacaaataaataaatccacagactttgcctaaagaaaaagggtttctgttagccagaaaaaccagacagctctctttctacaatgtgaataattacagtggagatgagagaaaaaatgctcagataaaagcataaaactatttttatgagagaaagaaaaaaagagataaaacagaaagatatccaacaaatcagagaagaaaaatgatagacattgaagcaatattgtgacctcagctatctgtatatcattgaacaaagtaacagtgataaagtgaacttgaattttttttgtttttgttttcgtttttgttttcactgagacagagtctcactctgtcgcccaggctggagtgcagtggcgcaatctcgactcaccgcaacccctgcctcccaagtcctaatgcttcagtctcccaagtagctgggactacaggcatgtgccaccatgcccagctaagtttttgcatgtatatatatatatatacatatatatatatatatttttttttttagtagagatggagtttcgccacgttgcccaggctggtcctgaacccctgacctcaagtgatctgcccacctaggcctcccaaagtgctaggattacaagcgtgtgccaccacgcccagcctgaacttgaaattttgactaaggaattattaaaatgatgaaaaaaattatcagatctgaaaggaagagatttgtgactaaaataggtaacccgaggactgtacctgttcaaaaggagcagaactatgagaggacgtggttcctgttcattgccctattaaatgctgtggtctgcactactggccagtctttttgaggatatgcatgtattgtaagtaccgacaagtgagtacctctgtgaacgtgctacttgcccatccttatttgtcttcacctgttgacaaaccttcaggttccaacagaaaacaactgttggtgaagttgtggagaaactggtacccttgtgcactgctggtgagaatgaaaaatggtataaccattatggagaacagtatggaggcacctcaaaaatttaaaaatagaactaccaaatgatctggcaatcacacttctgcttatttacccaaaagaactgaagtcaggatctcaaagaaatatttgtactcccatgcaaaagtattcactatagccaagatgtataaacggcatagcataaaccagagaaaatggtgaataggagatgggactaatgtgcagctctctcctggatggacagaacagcatctggagactcacattgtgaacttttgctccaagaaccaccacagaaacataccaggaaaaccaaaagaattcacagaccctttgaataaaacagcttgccactgcaaacaccacaagacagccgaaaaactgagctcccgaagtgtgatgggggaaagtcagcctccaaatacacatccacactggggagcctgaacaatgtaaatgtccatggatgaatgaatagctaaagaaaatgtggtatatacatgcaatggaatattattcagccattaaaaagggaaagcctgttttatgttacaacttgagtgaatcttgaaaacattatgctgcatgaaataaggtagtcaaggagggacaaacactgcatgattccagttacaggaaatatctgaaatagtcaaacccatataaacaaagtagagtgatgattgccaggggctagacagaatggaaaatggaagttgctactcaatgggtacagagttttagtcacgcaagacaaaaaagttttaaagatatgccaataatatcgtgcctatagttactaacactgcattgtaccttaaaaatgtgttaagagggtagatctcacactatgtgtttttaccacaataaaaagaaaaagagaaaacaatggctaaaacttaacaccacattaaatgtgcatacatgtaaaattcttgcccaataaccaaggcttcatggaccaccgacgtattttgatgatgaatataatgacaacagccaccactgaaccctcattataggtcaggcactgtgctaagtgttttaccagctttaggccatttctctttcccgcaaaactatgaggtaggtatcattaacatcattttaaatatgaaaaaactaggacttaggaaaattgattaacgtggccacagttgccctactggtaaactggtaagcagcaaaaaagaatttgatccaagatctccttgaatcaaaacctattccactgcattacatcttctccaggactttgatattctgctcatggaattaacataaaataaatttgcaaaaatacctcgggtagacatatcatttcaaaacataaagtaaacaaagaaaagctaaaatgcaacactgcaatacttgaggtctctttcttaacctcccacattattactgctattattatcagtcccaagataagatattttttaattgtgtaatttgaaggttgtagtgttttctaccttgaacaatctattataataaagggctggctagtgaaattctactcatttctaagcccctttattaaaatgctcattccaggagaaatgagactcatgaatgggatattataatctatttgctaaaggaacagaccagtagaaataatctgttaccataaaatgtctcctaaatatgtgtggaaataaaagtggctcattatccaatgatttcttaaacatatactttagttagcttagattaataaagtcaaaagttatcaggtttaaaatataataatttttaagaactaaattttaaaatatacaaccagaatgctctaaaaataacatttcaatatccatccactctccagctctccttcttcccgtgaccacctctctctctcctctccctgttctctcctctctcctctggctctcccgtgctggtcatgctaatgtcactgcggtattatgacattagcatttcaaactacattgaacaattctaactataatgctaagtaatgattaaatcatccttctttccagtatttatgcatagtctttcccccatttcaacaaattaaactgcccatcctgaattttatcatgacttccataggatgatttttcttataatactacaagattatgtttgtctttccgtaacaacaattcttactctagtaccataaaagtatgaaaagtacattcccaattacttcatcagtaatagaaataaaaaggacaggccccagaaccagtcccttcagcacactactcaccatattccatcaggctcatactactttttaaaatgaattttacaacatacctgaggccaaactttactggtttgtcaaaagactacttctcctgagaattcttcagaaaataactcaaagaatgttatgtataatatagattttaagtatatacatagatatgattattatatatctgaggcccaccagatggacaaaaccaatctagctggtactgtctgtgaaggctgacataaggttaggaagtcctggggctgtaccagatacaacagggagtcggaggttgcagtgagctgagatcgcgccactgtactctagcctggcaacagagcaagactctgtctcaaaaaaaaaaaaaagaaaagaaaagaaaagaaaaaagaagattctgatacgatttattcaaacagtgaacacctgccaagacataactgctgttagaagctggcatgctttctcacatgcagataagtattacatgaaatgaaaaagtggcctttgcattaagatctctatttgtcaaacaaatacttttgtatatactgatgccaagtttctgactgaagaagcaaactatgtgacgtcacttattcattttatttttgatttttaaagcattttctgaacactaatgttctacacacaattttacacacaaagtacataaattttgaacctataacatcaagggaaagcctataggcatatataaagtatcttaaaaacaacaacatttgccaaattaattttttaaacggaataaaagagctgagaggatgcaaaatagtggagttcttaaaatggagtaaaaacttagtcaagaaaaagaatgctgatgtagaactatgttttgccggctgtaacagacaatgcagaagcagaattcagtggtatatgacaacagaatcagggaagaaataagttactgtacagaaaatgatgaacagattaccttgtatgaacaggatatcttcccacattgggaactgaaaggtagcacttggaaaactaggttggacttcgtgaactgatgtaacttgtaagcattaattataataggcatgatactaggaactcagattcttaatcatgggaaaattagaaaaaaatgcatctattggctatggagtaagaggagacagggaagagtaattggcaggttactggaagagtcaggaatgaggcaacaacggccaggactcaattggtagctgtggaaacagaagggaagagagcagatccaggaaaattttcagagaggtaaaatggatgattctgtaacatactaaataagggagatgaaaagtgggaaaaacataaatcttccaggttcaaaatttaatgtgccaacagaatgatgatgatgccaactgacaagaggaaatttgggaaagggtattattttggtattaattatcataggtttgatttcctataagttaagtcttagaaaatataaaatgtctcatggtcttttcatcgtacaacatctactgacataagaagtcagtactggagatataaatgttggagttttacatacaaacttaattcgaaaccttgtaggagttaaaaattaaaaagggttagtattaggcaactacttggtatccacagttctcctatggcaaacccctatggcaaaaagagcaactaattttatcttatttcacaaacttcttatgaaaataggacatattttcataagaagaagaatttatccatgaaaataggactattttcataagaagtttgtgtgccactgcactccagcctgggcaacagagcaagactgcataagtcttaaagatagagtttatgatttataacaaaaggtgcttatgtcttaaagatacatacgtttatgatttgtgaagttataaatcataaatcttaaaaataaattctgataacttttttaaaaattgaaaactcatgagccactagaagtgtgaacattgccagcctccctaaagccttattagttaccctccacccaaaggtaaccactattttgacctctatcagtacaaataaattttgtccttttcaaactttgtataaatggaatcacacagtatgtaactttttggggtcaggcttcttcatgcatattatatgcctatgggattcatccatgttgtggaatgtaagagtaatatttttcagtactgtatatagcatgctaaaataatttacccattctattgatgagttgtcttcagtttttgactattaaaaataatgtggctatgaaaactctcatacatgttttatgatgcacacatgtacagatttcttttggttatacatgttgcagtgaaaccgctgtcataagatgtgcctatgtcaagcctcagtagttactatcaaggagcttttcaaactggatataaaaatttgaacttcttacagcagtgtatgagacttcagactattctgtatctttgtcaaaactttgtactgtgattttgtttttttaattttagccctttttgtaggtatgtagagatactgaatttacatttccctgactattaataatttgagcacctttttaagtgtttattaatcatctgaatagcttcttttgtgggctgcctattcaaatacattgctcttttttattgaattgtttttcttgatgatttttttctatatttaaaatgcaagacctttattgaataaaggaattgcagatatcttcttccattctgaattgccttttccctttttttctttttttttttttttgagacagagtcttgctgtgctctgttgcccaggctagagtgcagtggtgcaatctcggctcactgcaggctccacctactggttcaagagattctcatgcctcagcctcccgagtagctggcagcatgtgccaaccacgcttggcgaattgttgtatttttaatagatacagggttttgccatgttggccaggctgtctcaaactgctggtctcaggtgatctgcctcccttggccttccaaagtgctgggattacaggcataggccaccatgccagcctcttttccctttcttaatgatacctttggtgatcaaaaggtattaattttaatatatcctaatttattagtatctttctttaaggtaaacatttaatttcccttttaagaaacctttgactagtccaggccaagaagatattctaagatttcctctttaagttttatcattttatctgcacatttaattctaagatgttcctaaaatgggtttattaaatgatgtgaaggttcaagatgcattttttctatatgaatattcaattgaccaatttattgaaagaaccacttttcacagtaaatggcttggtaaaaaaaaaaagtaaataattgtaattttcattaaaactattatcctatattactagtccccaaaattcaaaagaacaaggagaaaatgattttagaattattatataatgaatatacattgagaaacaaaaaatatagccatcaccaaaataagtattgtaggaaattaaaatttttgtcaaacaaggaaaaacattatgtttgacctaagtggcaaatagagcagagtttaaatgttaatttattaaaaaacacctttaagcaaaacagtgtatagcaggtcctcaaataacatcatttcattataataacgagaaaaaaaatttggtttcattatatgtcacttcacttataatcagtttccaaaaacctatcaatgacattaaataaggacttactgtatacacaggctagtatatactgtatacacaggtcagtatttccttggtcaggtgagagggtgcaagagaaatgataccccaaccgcagcatgcataactagcacacagatattggtttccaataccatttctccatataatccgtattgatggggccatgtccaagaagcacagaagtcaaatgaaagagctcccaatggccaaagctggaacaatttgagcaacaaaatgaagaaatattggcttataacccaaagcataagaaaaatatccacattctcatattagtatgaataaataatagaataaattgataaataaggagaaaaagtctcccatgcagaaaaattccaaaaatttatatagataccccaccctcaagagcagggagtaaaactccctacttcttaaacacgggctgccaaacggtaacttcctttcaagtagtacagtatggaaaggtggggagtaactttacactggagaaacctaattaacactacctcagccagatgatcaaaattaatatgcacaggtatgatgtcatgttgataatatgtattcatggctgggcacggtgattcatgcctgtaatcccagcactttgggagactgaggaaggcagatcacctgaggtcaggagttcgagaccagcctggccaacatggcaaaaccctgtctctactgaaaactacaaaaattagctgggcatggtggcacacacctgtaatcctagctactcaggaggctgaagcaggagaatcacctgaacccaggaggcggaggttgtagtgagctgagattgtgcaactacactttagcctgggtgacagagagagactgtctcaacaaaataaaataataaaataataataatatgtattcatgatatgatacgatgagaatagcactttaactctgaggatcttcctgcctaaacccacaaccccagtctaatcatgaggaaagcatcagacagtttctactagatgggcattttacaatatgcctaaccagtcaatactcctcaaaactgtcacagtgataaaaaacagggacagtctgagaaattatcacaaccaagaggaaagtaaggaggcctaacaactaaatgtcatgtggtatcctagatgagatcctggaaaagaaacaacattaggtaaaaacgaaggaaatctgaataaatgaaagactttagctaatagtgtatcaatattgatttacttattgtgaaaagtgtaccaagataacctaagatgtgaaaaacaggagaaaccgagtgcaggttatatgggaattctctgcactatcttcttaaattttctgtaaatctaaaactattaaaaaaaagtgtctatttttaaatggtcattttattcaacatgatgaattggtgctatttggagattctctcgattataatcattgtgagcttgggagaagaaatggtgatagaaactataaaatcaaattctagctatctcagtgtgtccatgagtagttctatgaattatcatatgtcactactaacatagttaaatatttcagatgtctaaggcttttggcactctttaaggtaaaggatcttaacctaccttaacctaccatagaggatcatggatggaattcagactgtcgctgaatttgaattttttctttaaagttcactttcattttcaccaccctaactgaaagttaacatttcccaattgtgaatgtagtcatcagacaaaggtagcattagcaatacctggaacaaacagaaatcatggatatttttatagttcattacactactgagcaatcactatacattgtttaccctcattagaaattactatcatgcctactgctagattttgatatttactgcattaatttagaagcatatgtattactttatcacagttttgatttatgaatattttaacaactgtaactcaatataatttttctttgtaatcttttatttttaaaatactattctgagaaggactacacagaattcaccagattcccagcagggtccatggtacaaaagatgttaagaactccagtaagaaagcctagaatctcaataaagccgcccacagattttcagtgtgtctaaaccctaatgtcaatagaccctatcattttacagccttcatcttcccaagcatctagcaaggaagctataatttttatatttacgttttaatatttgttttaaaaatctattgtttgcatattttcactatgagtttctcataagaaaatccctgccaataccaaaatgcgtaagtctcataatctatacaagtgtctgcttacaataaatggcaataagacaacactagactcaacaaaaaagaaaaaagcctgaaagaacagcaaaacagagaaactgattctcagtgacagtcccgtctttcatcttaagccaggccttgaactctaccttgtttaattattaaatcaggagctgctcagcaagacctgtctacttttgacgattcttaaattcaatcctgctgacagactccgtccatgtttctctatatttactagtattacctatgacaaggtttgaatgctaatttttaaaattcaactttcattaaaaatagaatgaaagttctctgacaggtacctcttggctccaaagcatgacttttctttttatcccaaacttataaaaattaaaaattccattgtgaatgatatttctctcaatattatttaataaataaaatatacctatgcaataaacatcaaagcaatatattttacaaatttccattgtaatattatttaatatatttattaaatatattcactttgtgaagatttagaatgttgaaataatgaaaatgtattttagatttaaatttgttttttgtccatgcctttaaatatcaaagaggtatctgtacacccacgtacacggcagcattattcacaacagccaaaaggcagaagcaactcaactgtccatctgccaatgaatggacacacatgtggtatatgcatagagtggaattattatttagcctttaaaaaggaattttgacacaagccacaacatgaatggaccataatgacattatgcgaagtgaaatacgccagtcactgaaggacaaatactgcataattccacttacatgagtttcctagaatggtcaaattcgtaagagactaaaagtgaggaactgaataaagacggcaaatggagaattattgtttactgggtacaaagtattaggaaagatgacaaaatttggagctggatggtagtgatagttgcactacagtgtaaatgtacttaatgccactgaactatatacttataattattaaaatggtaaatttcatgttacgtctattcaataaaaaaagaatgacgaaaaagaatgtgatgatttatttgtatcctaaatatataaaatgttcctataaatcaaggaaaagaataactcaatttaaaaatagacaaaggggatgaaatggctattttaaaaggccaagaaatgtaagagccaaaagggaaatggaaattaaaataatacattttttcaagctagaaacaaaaaaaaaatttttttttttgaaacagggtcacactctgtcacccaggctggagtgcagtggtgtgattatagctcactgcagtcttggcttcctgggctcaagcaatcctcccacctcggccccacaagtagctgggactacaacgtgcactaccacgcccggctaatttttttattttttgtagagatggggtcttgctgtgttgctcaggctggtctcaaactcctgggctcaagtgatccacctgcctcagcctcccaaagtactggggttacaggcgtgagccaccatgcctggccaaaatattttaaaatttggtaagtccaagtcttggcaaggatgtgaagacaattcctactcttgttgagcagtgccataaactggtatgaccactttgaaaagcttactatggatacagaaattacactcttaaatacatactccctaaagcagtgattttcaaattgtgggtctcaatccatgtgaaatcaagttttaaatcacaacccagcaatttttaaatgaaattaaacaaaatgaaaaatacagaatatgttagagtaaatggccaatagtaaaaatgaaacttttgtttgagttataaatatgcagacagatgtgtgctcatatatgtacttgtgtatgttctgggcataatttattaaatttatttcttactgggagtcatggtcaaaaatgaaatgaaagccagtggcttagagcagcagttctcaaagtttggtcaacaaactcctgagcttcccaaagactcttttagtagatccacaaggtcaaaactatttctataactatacaaagacataaattgcctatttcactatcatttcctcacaagtgtacagtggagttttccagaggctacatgacacatgataccacaacagaataaatgcaaagacagatatgagaatccagttgcctgctaagacagacgttaaaaagttttttttttctttttcttttttttttgagagagagtctcgctctgtcgcccaggctgaagtgcagtggtgcgatctctcctcactgcaagctccgcctcctgggttcacgccatcctcctgcctcagcctcccgagtagctgggactacaagcgcatgctgccacgcccggctaattttctgtatttttagtagagatggggtttcactgtattagccaggatggtctcaatctcctgaccttgtgatctgcccgcctcggcctcccaaagtgctgggattataggcgtgagccaccacgcccggccaaaaagtttttaaaaatatagtccccaaagaaagcatacaccatactagtgtgtttaactactaaaaatgggtcccaaatttgactctgagcaacctaaacaaaatagaaaacatgatcgtttataaggatcttccatgagcatattaagcttttctccttcttaaatccaatggtttaatttttaatattttcatttataagtgataacataattaaaacaaaaattaaatcacattttttacctattttgtgagctgaattgtgtcctccaaaaagatatgttgaaggacaatctcccgtacctatgagtgtggccttatttggttggaaatagtgtctttgcagatgtaagcaagttaaaatgatatcatactggattagggtgggccctaaatccaacaacttctgtcattatgagaaggccatgtgaagacatcgagacagaaatacacaatgaaaatgcaaatgttgacagcaggactgccatgctgcagctgtaagccagaaaatggcgaggaccacccgcagccaccagaagctccacagagacaagaagaattttcctctaccagaaccttcaagaaaagcaggttctgctggtgtcttgctttcattcatacttcaggtcttcaaaactgtgaggcaataaatttctgttgctttaagccactcggtttgtggtcatttgccacagcagccctaggaaatcaacataactatcaaactggccaactttcggtttgtttttatttatttttattttcatttttattttatttatttatttttttgagatggagtctccctctgttgcccaggctggagtgcagtggcatgatctcagctcactgcaacccctgcctcctgggttcaagtgattctcctgcctcagcctcctgagtagctgggattacaggcacacgccaccatgcccggctaatttttgtattttgagtagagacagggtttcaccatgttggccaggctggtctcgaactcctgacctcaagtgatccgcccaccttggcttcccaaagtgctgggattacaggcgaaagccactgcacccagcctgtttttaattaaaacacccatctttggtttgaaaatgtagaagaacggacattcacatatactttcaattagagagtaattttattatgtagatattaatttttttctttttcatcatctcttttctaaagtttcaatagtgagcttgtatatctttttgcaataacaaaaactttcattttaaaaccactattgtcaccattatttaacatttttctgtaagttctagtcagtgtatgataaattataaaatacttgctacatacatgtaaagggttgaaatttctaacacacatttattcttgagtcttttctacagcagaaatataaaactttatacaacaaaagtttgagactcaggaataaatattacaaaagatgtcctaaagaccccagagtactgttttctttattaacttggtaaattgattctaaatgtacaatcatcccttgccatctgtgggaaactaattgcaggaccccctacaataccaaaatccagagatgctcaagtcccttatgtcaaatgacatagtacttgcatataccctatacaccccctgctgtatattttaaatcatatccagattacctacaatatgtctaatacaatgtaagtgctacataaatagctgttatgcagtacttttatttgtattatttctattgttgtatcatttttgtttttttttttatttttttgaatatttttatgtgtggttggttgaatcacaaatgaggaaccgatagatccagacagctgactgtatttgtaaaaggaaagggcccagaatggccaagactcttctgatgaacaaggaaggaagacttccttatcagacatcaagagtaattatgaagctgtaatagagatgacagtataatcattgcagagccagagaaattatccaatgttcacatatatagaagttcaatatataagagcaggcatgacagatcaatgaaggaaggaggaattactctaaagtaaagctgggaaaaaaaagttatccacatagaaaaaaacaaaattaaatctcttatcctgcattagtcacaaaaactaactccagaaggattaaggcctcaatgttaaaggcaaaactttaaagtttttcatagaatatataggcgaaccttcttgcacttacaatacagacagatttgtttaacaagacataaaaagcactattttgttttttttatttttgagacagagtctcgctctgttgcctaggctggagtgcagtggcgtgatctcggctcactgtaacctctgtctcctgggttcagacaattctcctgcctcagccttctgagtagctgggattacaggtacgcatcaccaagcccagctaattctgtatttttagtatagatggggtttctccatgttggccaggctgatctcgaactcctggcctcaggtgattcgcccacctcggcctcccaaaatattgggattacaggggagagccaccacgccaggccaaaaaagcactaagtgtaaaagacttatacatttgactaagttaaaataagaacttctttcatcaaaagaccatctttccctccaaatcctatcagctgatgtattacaatctaggagactgtcgctctccaaagttgtatttctctcccttaggattacaaggcttgctgatcgcacatgggaatttgcaaaggagagttcaacagtggtcctgtggtattatggagatctctccctgaggttcaccccatccttgctacttgaacagactctaattgaccaaaacaaggacctagtcttccaggttttccccaatatgcgtaagagtaacttataaacccaagggacatgggctcacagtccaaaatatctagatacctcaaaaaaaacactatgaaagaaagtcagcagtacttgcatatatataataatattatcacctatattatcattcataatacacagcacattatgacttatataacattctgaagataaattatgagaacagatgaactaagaattttaaataagcttaattaataaagagtcaaatgaggccagctgcagtggtgcacacctgtaatcacagcactttgggaggccaaggtgggtggatcacctgaggtcaggagtttgagaccagcctggccaacatggcaaaactccatctctactaaaaatacaaaaatcagctgggccatggtggcacacacctgtaatctcagctactctggaggttgaggcaggagaaccgattgaagccaggaggtggaggctgcagtgagctgagattgtgccactgcactacatctgggcgacagagtgaaacttcatctcaaaaaagtaaataaataaagagtcaaatgaaaatactaggtataaaaaataatcactgaaataaaaagtaatagatccctaagcaggagtaactctaccaaagaattaactgatgagagtaaaaacagaatgagaaactatcatagaaataaagaataggaagaaaatacaaagagatagaaaatatagcataagacctaagaggtagaagggatagatcttttcaaagaaataatgattgtaaatactcagaactaaattaaaaaactcaaatttaaagggctcaaaataatgccaaaaagtccataactagagacattatagtgatatttacatatataaaaatcaaagagatgatgttcaaaactgctcatctcagatcttcatacttgaaaaccaagtggggtcacatttttttctaatgtttattttttattaatagatgtggctccagtgtcttctggaaatggatattgagataaagaaacctaaaggtatttcgcattttttctcatattagtgacttaattttttgttgttttttcttcagggtaggggaatggggagaggatgtcagtgttttacaatttggacactcaaaggattctagagcctcaaggactcccagggatctgttcaccacacttggccagttgccatggtaaaaacctcaactgtgcctgaagtctcccaatccagagactgttgtattctctccagaaaataacctagtgtcttctgctgagttgtagaagagacaatcccatgcttcacaaaatgggggagaagatataaagatttggtcattttttattttattatttttaaaaagtcgtattatcaaatatctacaaaattacaaagaagagtataaaaaaaccccttgtacctaacactccaattaaacatctagctgcctcttaaataggccttctagcaatttatgtgttgaagggccacttatcagccctcttccagagatgcctggagcctctggagctcccatggtgtaattcatcttgcttctcaggttccttcactgctgatttagggttatgctttcttgagcctgctagatcaatttcaacaaatccattgcctttccaactccaaaaattgtattgctctcttattctctttgtccatcagggcttacacctttttctttaccctattcctattatttccatggaagggaatggaggcccaaacaattttccactcttcatcaaacaaatgtgttaattttttcttttttttggatccattgcccaagctggcatccagtagcacaatcacacctcactgcaaccttgacctaatgggctcaagtaatcctcctgcctcagcctcccaactaactgggactacaagcacacccccccgggcctagctaattttttttttttttaagagacatggtctcaccatgttaccctggatggtcttgaattcctgggctcaatcaatctaactacctcagtctcccaaagtgctgggaacttcttaaactgagtccttctttttcgtttgtgtgtctctcttgattgtcattcttgtatgtttcatttttgaacataatattaacaatgatctgagtgtttattattgtgtatattaatataatattttatgtatattaatatatgtatatattatatacttaatttatgtatattaatatttccaacaacttacattatattgtactactgttattctattccacaaataagaacaattaacatctgaagagcttacatgacactcaagctattaaggagttggaatttgaacccacaactgtctgaccctaaagtccaggttccaaacaactgtgcataccacttctcatttctttttcaatgtgaggtagaccttagtgctggtccaagggtgcaaggtaacacactctaagatatatgtgtcatacgcctgcgtaacaactcttgtttaaattccacagctttaaattcaagaaagtacttggaccaagccaggctggcctggggaggttgtgaatggtaaatgagacagagttcatgcctgggatacaacacttgaccattctatgaggtcatattacatacagatgctccttgacttaaaatgagatcatgtcccaataaacctatcattaagtttcaaatatcattaattcaaaaatgcatttaatacacctaacctaccaaacatcatagcttagcctggcctatcttagatgtgttcagaacatttactttagcatacagatgggcaaaatcatctaacacaaagcctattttataatgaagtatagggtatttcatgtaatttactgaatactgtattgaaagtgaagaacagaatgaatgtacagatggatggtccccagcttacaatggcttgacttacatgactttttgactttacgacagtgcaaaagcaatatgcatcactttaagtacccatgcaaccatttttggaaataagcccatagtaaattgaggagcatctggtattctactgaatgcatcttacctttgcaccaacataaagtcaaaaaattgtaagtcaaaccatcgttaagtaggggaccatttgtatcagtaacaagactgatgcgatgcactgaacacggacatgaggagctctgagccacatgcagagtagccttccagcaaaactgttccaggcttatggatcttgagatgtaaggcaggttcctaaagagctgaagacagtcacttccccagacctagactccacagccatatatatatataatcaatgaagattctctttgggagatcctctatctcatcctgaccagtgtcacaggtctctctgctgtgtagcctgactgtggtgacctccttcctgaattacttcagtaaggaccattttgggcttacccatgtgatgtctatgtctggttcccgagttaatatgatctattaagaacactggtcagagtggtcacactactccaatctccctctttgatttccttcacattagcattattttcagaaaaacaatcaagtcttccatttaaaaaaaaatgaaacaaacaaaaaaagatagaaaagaaatggccaggcgtggttgatcatgactgtaatcccaacactttgggaggccaacgcgggcagatcgcttgagtccaggagttcaagaccagcctggccaacatggcggaaccctgtctctactaaaaatataaaaattaatcggatgctgtggcatgcacctgtagtaccagctacttgggaggcttaggcacaagaatcgcttgagcctgggaggcagaggttgcagtgagctgagactaagccactgtactccagcctgggcaacagagcaagaccctgtctcaaaggaaaaaaaaaaaagaaaagagattatctctgaactgaaagtcaatggaaaaaaaaacaagaagaaaaaagatttataaaggcttctgagggttaaaaaataataaataagactaggtacaggggctcacacctgtaatcccagcactttgggaggccaaggagggtggatcacaaggtcaggagttcgagaccagcctggccaacatggtgaaaccccctgtctactaaaaatacaaaaaatagctgggcatggtggcgggcacctgtaatcccagctactcaggaggatagtttgaacccaggaggcggaggttgcagtgagccaaggccatgccgttgcactccagcctgggtgacagggtgagactccgtctcaaaaaataaaagtaaaaataataataataataaataaaaagcagcattaaacacactagagtcaaatccctcacagacttcaagggtctgtccatggccacacataaatctgtatggagtaggaaggtaaagtttttcttttgattctgtaacacacttctttctacactgtgcacatcagggaaacatgaggacatggaaattgagaagacaggttctaagatgtcaagaacaggtttaaagactcactgtggactgtgtttgcgccatgtattcactctccattttattcagacgcacatttgtatcctcaagcaattcttgaatgttttcagtgtgttgcttttgaagatcaaacttttcctgttccatttctgctacagcattgtgaagctacatcaggaaatcaagagttgactcttttactactatggaattgactattttgtaattcagcggaaaaaatggtttctatattcctctatttatatatatgatgacctgaacaccaaaagatacaaaaaaccaccagtaaacattcaaggtaaagatatcatataaaaagcaggatcaagaaacacttaatttttcctttactttcctgaattgaaaattttaatggatgaacaaatattaaaaggaattatctgcctcaggtagaaatggtaaataaatcaggcagataatacaagtgaacattactagtattagtctgaaatgagaaaacagaaacattataatattgtaactaattaggaatattgtcccattgtccccattattcatcctatttgcacggaattttgtacaccagtaatgttaaaaactgctttctcccctacctgcacctcaaacaagaaattacttctagtcattccctaatctatacaaaaacagacaaaaagatcacatttatcagtcaaacaatatgggtaggatgactaagcagaattgtatactacatgtacagaggtctttatttataaaaatcattatgtatatactgtttaaatggatgagcttttaaaatttctacacaaactaaggtaaggaaaacaaaggcaaatacaggaggtccagacaagcttcaatggacatcttccaaaaggggttgaaaatctgtgctcccagccctgtgggcattccttcacttatcttaatgggggtacaactccgagtctaacttccattccctgcatccaaccccacacctacccaataggagaagagaccaggagtccaaacagtccaaatgatatatttggctttttgtttttgtttttgttttgagatggagtctcactctgtcacccaggctggagtgcagtggtgcaatctcggctcagtgcaacctccgcctcccaggttcacgtgattctcctgcctcagcctcccaagtagctgggatcaaaggcagccgccaaaacatctggctaattttttatatttttagtagagccggggtttcaccatgttggtcagcttggtctcgaactcctaccctcaagtgatccacccgcctcagcctcccaaagtgctgggattacaggtgtgagccaccgtgcctggccccaaataatacatttgattcactacctataaatagggaagagagaaaggacaaatagaggcagtgtgaactcttatttgactagaaagatactggaaggacagggaaaacctgtgagagatggaagctagggcagaatgcaggcaataattatgataattgtactggtaaaggtctcaagaacgcttcttctagtttctagctgaataggaagaatgaggatgctcagtaatagccatacagaagactcctggattttgcaagtttaacatacacagttttgattatttgtaagtggtccccgaaatccctgatgtatctaatttttagttttgctgaaataaacattgtaaagcagtattaggtctgttgttcaaaagtgagtcacatagctggtacaatgcacccaaatctcagtgctccttcacagctgtcgagtgacatgatagtaactcagataatgggctctaaaggagtcacttagaattttacagttgtacttacaggagcaattatatgatgtagtggtttcctcatgtttaaggtctcccaaagcccctagaacatatgcctgccgaatgtcaaaaatctaatagcccatcaaaacttagtggtttctcatgtgtcttccacagttgttttataaagggaccgtcgctgtcggaggggtggctgtaagtcagtctacaacactcatccaaggaatttgtagttgagactacaagggtaaaaatggcactggcaaaaacaactatgctattacttggctgatgtgtttgaggactagataggcatctggtctcatagtctaaccagaggtgattaaaatgtattcattcaacaaattttattagtacctgctatgtaccaggcataatgcatcagtgagcactttcccaaacctaacaatgaattggagtccaggtcactcagtctaggaggctttaaagggcaaacgttcctttaagggataaactatcttagtagcaaatattattaggctataggatacaaatcttgctggagtttatgaaaccataggacataacaatgagttgatccataggaattctcaagaagaatttttacccagagtttgataatgggtacaggagacaccaatgcccttcccagcatcctacatattcgtctttaaccatatagttggctcatgccagaggagacccagaggcaacagaaatctgtcccaaataaagggaaaagtattacaaaaccccacaggtcaatagcgcagccactgtggaaaacactttggcagttcctcaaaaaatttatcaaaaagatacacagagttaccacataacccaggaatcctactcctaggactacacctaacagaatgtaaaaacacacacaaatgttcacagcaacattattcacgatatccaaaaagtggagtcaactcaaatgtctatcaactgatgaatggataggcaaaatgtggtctatccatacaacgcaatattatttgaccataaaactgattgaactattgattcatgctacagtgagggtgaaacttaaaaacattacggtaagtgaaagaagccagtcacaaaatgccacatattatattattgtatttatatgagatatctagaataggcaaatctataaagacaaacagtagattgatggttgaagagcctggggtgtggggagtggtaactgactgctgatggataaaggtttctttctagggcaatgaaaatggtctgtaaattatattgtggtggaagttgcacaactttgtgaatacatcaaaaaaaccaatgaattgtatactttaagaaggtgaattttatggcatgtaaatcataactcaatattttttaaaggcccacagaacagcaaaacgtgttgacagctggggcaaaagtcaagacaggaagaagaattgtgagaaaagatgaggcttgaaagatcaccagagtctttatcatgaaaagccttgtaagtcctaagaactaaggaaacaatgggagccactaggacaatgggaaacactagagtgatttaaacatgattgtgaggtcaaccagatttgtgtttgtgaaagaccaatttggctgtattgtgggacatggaatgacgacggacagactggaggtagaggccagttacaggtgatctaggcaagagacaggggtctcctgaactaaggaaggaagagtggtagatacattcaaaagatgaataattaacagaacttggcaaggcattagatgtgtgagctgaagcaaaaagaagagtctttaagtagctgagttgatccctatcccatagagaataccctactgggtaggtatatccctccatgggataggcatctccatgggataggtattctccatgggatagggaaaaaggaaatacccattttagcaacaaacgaagaagatgaagtttaaggacaatgatggaattcagaccaaggagagattttaaataggtagttgaataactgggacttaaggtgagagacataggatgcatatttctattagggaatatacacacacacatacatatatcaccttgtccatgtagaatacataataattgttgaatgaatgactacataaataacaaagtgtatctaacatgtgcttattaattttggtgcctgtcctgcttgtactcagttttcatctcagcccagatttacataaaattactctacacacacacacacacacacacacacacacacacacacagccttcagtgagggggcaggtacagtggctcacacctgtaatcccagccctttgggaggccaaggcggaaggatcacttgaggccaggagttcgataccagcctggccaacatggaaaaaccccatatctacaaaaactacaaaaattagccaggcagtggtggccacacctgttattccagctacttgggaggctgaggcatgagaagagcttgaatccaggaggcaaaggttgcagtgagctaagattgcaccactgctctccagcctaggtgacagggcaagactctaaaaaaaacaaaaaaaaaaacttcaagcaggtttacgtatttacacatccactatttattgtataactagaaaaaaaagctttactaatccagcagaaagaaaaagacgtacccttgtaagtggcagaagcctcttctcttcaaatacctgacaatttaaactagaatatatgaaattagggaattcagacaaaggaaagcaggggacttgctaggtacacaatgtcattgaagtaaatacaaaaatatgccaaatttatagaaaagataaaaccaaaatgtgagaaagaaaaaccacatgactagaaataacaaaataaaaactagaaaagaaccaactaaaaagcaatctatagattcaacactatcctatcaaattaccaatgtcattttttacagaattagaaaaaagattctaagattcatatggaaccaaaaaagagcctgaatagttaaagcaatcctaagcaagaagaataagtcaggcatggtgcctgactcctgtaatctcagcactactgggaggctgaggcaggaggatcgcttgaggtcaggagttcaagacaagcctgggcaacatagtgagaccccacctctacaaaaaaaagttttaaattagccaggtgtggtaatgcacacctgtagtcccagctactcaggagactgaggcaggaggatcacttgagcccaggagctcaaggctgtggtgagctgttatggtgccattgcactccagactgggtgacagagcaagaccctgtctcaaaaccaaaataaaacaaaagaacaaggccagtgggaatcacattacccaacttaaaactatgttataaggctacaataaccaaaaccacatggtactagcataaaaacagacacatagaccgatgaaacagaagagagaacccagaaataatgatgcacacctacaaccatctgatctttgacaaagttgaccaaaaaaatggagaaaggaccccttatccaataaatgggatgagataactggctagtcatatgcagaagaatgaaactggataccccacaaaacacaaaaattaactcaggatagattaaagacttaagtataagacttaaaactataaaaatcctagaagaaaacctaggaagtaccattctagacattgaccgtggtaaagaatttatgattaaatccccaaaagcaattgcaacaaaaataaaaaatggacaagtgggacgtaattaaaataaagaacttttgcacagcaaaagaaactatcaagtaaacagataactcacagaatgggagaaaatatttgcaaactatgtatctgacaaaggtctaatacccagaatctataaagaactcaacaattcaacaacaaaaaacaaataaccccattaaaaagtgggcaaaggacatgaacaaacaattctcaaaaaaagacatacaagtggccaacaaacatacgaaaaaatgttcaacatcacacgtcatcagagaagtgcaattcaaaaccacaatgagataccacctcacaccagtaaaaatgggtgttatttaaaagattaaaaacaacagatgctggcaaggttgcagagaaaaaggaatgcttatatactgttagtgggaacgtaaagtagttcaaccactgtggaatgcagtttggagatttctcagggaatttagaacaactaccatttgacccaacaatcccattactgggtatatacccaaaggaaaataagtcattctacaaaaaaggcacatgcgcttgtatgttcattgccatgctatccacaacagcaaagacatggaatcaacctagatgtccatcgatggtggattggataaagaaaatgtggtacatatacaccatggaatactagatggccataaaaaaatgaaatcatgtccttcgcagcaatgtggatgcagctggtggccataatcctaagcaaattaatgcagaaatagaaaaccaagcatgttctcacttacaagtgggagctaaacattggtatatatggacataaaaacaggaacaatagacactggggactcctagaggaaagagggggacaaaggctgaaaaactactgttgggcactatgctcactacttggatgatgggatcattcatatcccaaacctcaatgtcacacaatataaccatgtaacacacctgcacatctaccctctgaatctaaaataaatgctgaaattattttaaaaaatgaaataaagtatccataatattcaaagcaatatacagattcaatgtaatccctatcaaaatatcaatgacattttcacagaaatagaaaaagcgatcctaaaatttgcatgtaaccacagaagattctgagtagccaaagcaatcttaagcatgaagaacaaaggtggaggcatcacagtaactgacatgaaaatatacttcaaacttgtagtaactaaaacagtatgctattggcataaaaacagacacacagaccaataaaacagcatgaagcacccagaaaaaaaatccacacatttacagccagctgatttttgacaaaaatgccaagaacatacaatggggaaagtatagtctctttaataaatggtgctggggaaactggatatccacatgcagaacaatgaaattagacctgtatttctcaccatacacaaaaatcgacgcaaaatgaattgaaagacttaaatggaagaaccaaaactatggaactactaggagaaaacatagaggaaaagctccatgacataaatctaggcaacaatttctatacagcacctcaaagcacaggcaacaaaagcaaggaaaaaaaaaaagacaaatgggattacatcaaactaaaaagcttctgcatggaaaaaaaaatcaacagagtgaaaaggcaacctacagaatgggaaaatacatttgcaaattatacatctgatatggggtttatatccaaaatatataagaaactcaaacaactcaatagcaaaaaaacaaatattctgatgattaaaaaataacctaatgacttatttaggccaaggacctaaatagacatttctcaaaagaagacacagaaatggccaaaaggtagatgaaaaatgctaaacctcactaatcattagggaaaggcaaaccaaacttacaatgagatatcatctaactgtagttagcatgattattattaaaaagtcgaaagatagcaagtgttggtgaggatatagagaaaagagaacccttatatactgctagagggaatacaaattagtacagccattagggaaaactgtgtggttcctcaaaaaattaaaactggaactaccatatgatctaacaatccccctactagatatatatctgaagaaaataaaatcaatatgtcagagatatctgcattcccacatttactgcagcattattcacaatagtcaagatatgaaatcaatgtaagtgcccatcaaaggatgaatggataaagaaaatgtgatagatacacacacacacacacacacacacactggaatactattcatccataacaaagaatgaaatcctgccatttgcaacaacatggacaaacttagaaggacattgtgttcagtggaataaactgggagcagaaaaacaaatacataatcacactcgtggaattttaaaagttgagctcatagaagtagagaacagatagcgattacaagaagcaggggaggagagggaggaaaggggacagagagaagttaaaaagcaggtataatgttacagttattgatagggtttggctgtgtccccacccaaaatctcatcttgaattgtaatccccataatccctatgtgtcaaaggagagaccaggtggaagtaactgcatcatggggtcagttcccccaagctgttctcatgatagtgagtgagttctcatgagatccgatggttttataagtgtgtggtagttcctcctgtgttcattctccttgccgccttgtgaagaaggtggcttgcttccccttcacctcctaccatgactgtaagtttcctgaggcctccccagccatgctgaaccgtgagtcaattaaagctctttcctttataaattacccagtctcaggcagttctttataacagtatgaaaatggactaatacatagtggacaatggacactaatataggagaaataaattatggtttatttataataaaaatggacaatataataaaaatggacaataatataggagaaataaattatggttttctaatgcacagtagagtgattatagtttataataatgtattatatatttcaaaaagttagaagagaggaatttgaatgtcctcaccaaaaagaactgataaatgtttgaggtgatagaaatgctaattactctgattttatcagtatataaagtatctatgtattgaaatatcacactgtaccctaaaaaatgtaaaatcattacatgtcaatcaaaaataaaataagtttatacaataaattctagtccatattatattttctaaaatttcaggaaagaaatactccaatggcccaaatacaaaattaaaatggcttaatttccaaaaactgttttagtgctatttaactaattttgtttaaaatctgttggctgataagaaatccagaacattaattaaattcaagagctagtcaaaagaatattttctaaatgaaaactattttatagaccatagacttccagaagaaaatataccaaaacatgaacagtagctatttctaaacagcctggaattttagttattttttaaacttttctgtatattctgtgaaatctattacttttataattaaatatgttacttggaagcataaacttttatgttttccattagtattttatgtagcttacctttttttcccagtcattatttagagattccgtactttgttcacatatctttttcagctctgcaatctggtcttctttagtctctctgataacttgacagtcacgtatcagtgtctgaactgtcaaaaattttgaaaacatagttaaaccaattctaggtacatagagtttgatgatataaaatttagtgcaccagttagtaggtaattcaatttttcaccaagtcttctcaatgctttcttctaaaatatcttttattccttgctctttttctcgatttctaccaccacagacagccttggttaaattcatcattactggctccctagacaattgtaacagtgtattggtctcaagcatcattcccctccaaggagtcctctgttgctttgaggaaatctttcaccattattctaagtgaagtaactcaggaatggaaaaccaaataccatatgtttttacttataagtggaagctgagctatgggtatgcaaaggaacacagaatggtataatggactttggagattgagaagcagggggtggaaaagggggtgtgggctaaaaactacatattggatacaatgtacattacttgggtgatgggtacaccaaagtctcagacttcaccactgtacaatgaatccatgtaaccaaaaccacttgtaacctaaaagctactgaaattttaaaaatttaaataagtaaagaggcctttcactggtgcaaatctggtagttatgcccaggcttacaaacgttctacagctcttctcatctaaaagataagtataggtcaaagcctctgacatggacaagagttcctcatggttctggccatatctcttcccacttgcatgttttaaaccactattataaacacaccaacctatatgcagattcctgagttcatattctttcttatatcactgcctaaatatgatcatctatctacatagaatgcccttccctcccttattgaaaaactcctactcatccttagactctcaactgaaaaatcacaccttctttatgaaccagtcataaagaatcactaaatcatgattcactcaaccagatttctccccttgcagggacagaaagaaattcctctttattcccatgaaaccttgagtatttctcaattaaatcatttattaacattatagtgatttacttgcctgtttcctctttaatgagactatgttcacggagaagaaagagatttcaactttttatccacagggcataacagtgccacacaggcaagtgctcaaaaagacgtgtactgaatgaataaataaaggaacccctcctttcaatatattgttgctgctagatacttttaaatcatttttgaagtttatgttactaaaatgaaataggttttaaattatataaaatatttgccttataaatcatttctctatcttctttactaaaattatttaaacagtcactgatttaagtgaaaatgtgtttaatatattcatctcttctggatagtaaaataaattcagctctatttttaattggatataatcttatcatagcttactaaatatgtttttattcatttacttcgagacagcaaaatttttgtaaacatttccctaaaaattgttttcactcttatatctcaactacacaacaaataaggagaggagatgaatccaagttaacctaatgtgggtctttaccatctacaatatattttactttacacttccaaaattaaactaagatctgattgcaattcaaaatgcctttagaaacattatttttaaaacctcatcatttttaaaccttaggcatgtttgaattacctattttgaatcagggtaaagaagaagacctggaaataaatttaaaatatttttctagacactggtaatatttggagaaaaaacctaaacgaatttataattgcttttaccaacatttaagggtggaaatgaacctacaaatatttatttaattggttaacttatctatgtaatggctgtcctaatttgtcaaagccattatcattcactcagatatactcaggtttgatctgggggagagccagtaagttccatacagaaaatcctaaatgaaaaccttcccttctccttttctcttattcattgcctagatcttctcattcactaaatcatgattcactcttaaaaacttcttcttttcttcggttccattctaactactcccagcgccatcattcagaaatccttctcaccttaacatgcaaaattacagcagcacagaagcagaacatctctgagttggcagggactttatatattatttattctgatctcaccattttataatgagtaaaccaagacccagagacaacttgctatcatacatcggacactggtaacagagctggaattacagcctatgttttctaataagtagaattctctctccttcactccattctgcctctgcctaacagacttggaattggcctactctgttcaatacaccctccattaccaggctactcctcccaaaacatgaggtcctaaaactcacatctcaaaatccttccctggctctttacatccagcatctacaggacaaagttcaagcttctaaatctaaaattcaaggtcatacttaatctagccccaagtcaactatcttaatattttaaaatcttttttttttttttttctgagacggagtcttgctctgttgcccaggctggagtgcagtggcacggtctcggctcactgcaagctccacctcccaggttcatgccattctcccgcctcagcctcctgagtagctgtgactacaggcgcccgccaccacgcccagctaattttttgtatttttagtagagacagggtttcactgtgttagccaggacggtctcgatctcctgacctcatgatccacctgcctcggcctcccaaagtgctgggattacaggcgtaagccaccgcgcccggcctaaaatctatctcttaatgcatggggtatccattctagctaaatagttgagaagtacccttcctacaacttacctatttcagcattcccatcccagtacctgcaactcttctctccaactaaccaagactttaaaatttcacaaaattttacaaaagttcctttcccaaaacaatattttcaacactctctctcatgaccacctattgatgtagatgtttcgacccataatcatagtcaactacggtcagagttagctcaagtggttacctcctcatgccggactttccatctgtccatagtcaacttaatacttgattacatgctttcttttccttcttaattaaagtgcaaataggaaatacattttaatttttttctgtcaatcacaataccagcaaatactatcagacataaaagtagatacttaatgtaatgaattttactagataaagaagaataatttcctttgacttcctcatgaaggccagtaagtcctaattctatgactgccctcaatactctatggcagctgtatcccaatgaggctagagttaagaagagggagtgaaagcaacatactcttccaactctgtatctaaaccaaccaccagtactactccatcactgtcactacacaaacacacacacagacacacacacacacacacaaataaacacagtttttgccccttcatatggaagcctatataaatatatccactgatgaaaccccacataaacattcctatctcatactataaaaggtcagaaatcaaatttttttctccacatcactaaaataaaatggaaatgttattaaaagatgtatgtaacaacacaacatcacctttcttttcaagctttctaatagtctcttcagtttcatgttgtttactcctgtataaagttttcagttcttctatttcattattctttctttctaaaatctgcaaataaatttaaaatatttcagtatattgtactactttacatataggacacttttttgaatcctgatatatttaattctaaaacataaatagaaaaagtgattttaacaaatatgactacactgtgaaattataaacacacacacacacacacacacacacacacacacacacacaaagtagtatctcttatccacagctttactgtctgctgtttcagttagatgcgtgtgtttttgtgtatgtccatgttaataattctagcctagtcagaagttcacgttttgctcttgcagcagctaggaggtagaatctatatgatctgccacacttggaagcttccaagttgcctgaaatcgtgagactttcctccttttgactagtgaatattgccgcaaattggcattgtagtgatttaagtgactttttaaattgattctcaaatgtcagtgttttgtaaattaggtagaagtgttttgtcctgaaagggagttagggattctttttctcagattagcataaaaatagctgaaattgtatgtgtctaatatttctcttcacatatttttcttatacttacgatatctactgttgtttatctgctagcaaattccagcagataataagtgaatggtgaattagtaggtatacattaatagaaactcgtaaagaaccaatcatataacttttcaatgagcataatatttttgtaagtctatctcagctaatctcataaatggtttccccccaaactgtaaaaattatattatagtgcattaagaaaattattaaatatacaagaataattattatctgaaagaaatacgttatctgagatttttgtataataatttttaaggacagtataaataataatttcagtgattccctaaaatataattcagaaattaagctgtcataaagtggcagagagaagtcatcagaaacttgccaggttgggagagtataattcatcacattgcactgggatagaatattcttcagctgggcatgtccctggatccgcccacaagcaccgttctatcctcctagtgcacagtaaaagaattcccagatacatgaggagatgacatgtaatcagcctcctttatatctagctctgctactgtgaatcagaaaaatcagctcaaaatatgtcaaaaattgcattaaaatctattgttaatttatattatgtcagaagttttaaatgtaatcatttaataaaatttgtgattttatacttcaaaatacatctatactcacaaaaactacagaaataaccaaaatgtaaaaaagatagcaagtaagagaaaatgctaatcaaggggaaaaaggaatatctacttttcttatggctggggtatatttcccatacacccaaaagtcagcttaacaagaacaacagaaaagaacggggcacagtagcacatgcatatagtcagctactcaggaggcttacagatcacttgagcccaagaattcgaggctgaagtgagccatgatcatggatcatgcctgtgaatagccactgtcctcctccagcttgagcaacatagcaagatcccatctctggataataatagccataaagaagcaaaaaagaaaaagaatgtatactaataggtaaaacactctaaattttacgccttgccaattcctgatgcttagaaaatgccagacaagagtaaactgatgaatatacttttcaaatctagcataaaggattttatttatattttacttggcacttcaaactagttgcactgtctgctgcaaataaatttcaggatttattttaaagagaaattgctggaaagaattttattattaaatatgttactttgagtaaatctttgtaacagacataccaagaaacctatttcaaattccatcaccgtaatttttccaaataaatttttatattcatttatcttatacatcaatagactctatttcaattgtacatgttatattgaaattatattactgactctctaacatacttatgatagagaactattatctaaacaatttaaactaaagtaaaactctagtaagagcaaaaaaaatttgcctgtaatatctgaatgggggagaggaaattggaaaaggagagttcagtttttttttctctaatatccagtcagtggtttcctccttattgctttaaaggacaagccaaatacgtattttactaaatattaatatatatatattaagcttttaagaaagcttggatacataatcctgatgctgtaactactgcaactacctgcctctgtctctagtactcagttttgggaagcagaatcataggcttagttttgaaacattaaatgcaaagtttccatttggatcaacctccatgtatttcaaaaaaacacatacatacattattatcactaaatgttttaatcattactaaaatatagtaacaacccaaatcccatataggataaccataattaacaatttttgctgtgccagctaagaaaaaaaaataagttttatttgaaaatacaggctgaaagattagaaagcatcaatcccaatgagctacttgaaaaacaagcctttattgtcagtgccagcactaaaatgcatacaagtccaagagctcctttttaaattaaaaaagaaatttaattaccagaaaaccaaaagaatattagaataaaacaaattctagtatttaccattgatgtcttatttcaactttcatgaaaggtaatgacagaatgcagataaaagactataagaaggtcagcctaaatgcaatagttaaagaaggactaaaaggtaatgtaaatataaggttttaaataaacacatatgtttagctaataaagttaaaaaatcaacttttgctgggatattagtttagcatattccacttataacagaatgtcataaagtacataaataagtggatggatggttggaagaatggatggataactggatggatcatcataaaacctagaatatttttagtgttcaatataattaaaacacgagatatatatcctaccttctgaacatcagcatcatgtttctgttgcagtttaagcttttcttcatgaaatttagcttccatcatttttgttttcatgtccagcttcaagaaaaatatttcaagggtgttattaatttactttccctttggcaaaaaatacacaattaaactaaaataattccctataaaaaagacagttatcattttccacctttaccttgtagtcacagattctagcaatcacattacatataccaatatgtttatttcagtcctctaattactttcaaactagttaaaagtctttaaaataaatttcacctggtaggcaaaactgacaatatgaagtacagattcactactctccccattctctcccgcacaaaagagaaaggcattttaaagtgatattttgcttttacatttaaatccacacagtattttactcttcattatttttcatttcagtaagtctcttccaaccttttatttttttttctttgatctacttgctcattttaaaatactctaattaacctacatatgtaaatatgacttgagaatgaatatccataaaaatggcaaattactgattagtgcatatctttcgacagtttttcagttctctctcccggaatcatagacccccgctccctcaagggagtgactttatctccttccaagcattccttaacttctatcctctccaaaccaacaccacatgcaacggtgctctgagcaaagccaaaaatgtaaccaatcttcttaatataagaagggtatcctagaattaaaagagcaatagtgacaggtttcaagaagagcaacataaaattgattatctcaaatgtgaaagtatttggtcacatgattcctcacaatttaagagagttaagtgttatacattggagtctggcagacctcttttccaactctaattccaatcccaccatatatgcactgttgtgactttgagcaagtgaccctttgacactctagttcctcttctgctaattaaggaaaagtatccttacctcagtggattgtgaaaatcatattcaataaaataatttaaatgaccatacccaggacaatgtgtggcacaaagtaagtatgcaaaaatatcagtcaaccacatttaggaaaaacattttaatattattaatgtaccttcaaaatattttcttgaaaatttttgaaatacactttatattttcaattactttttcaaatacaaaataaatttagcaagataaacatatatatcatattaacatatcaaactgagattttatgtttcacaaacaaaagttaacataatacaaattcatgacttaaatgttatgaatggtggagaaagagacagttaaccatttgctatgcaaaaaaaaaattcaattcccttgcctctaaatcacacaatatttcttcttcgtttttgcagaaaggaggctagacaatctaattccatgtaaagatccttcacagaagcatttttggggtctattaaaagggaactaaagccaaaaaacagtatgacaaagctggccaggtctaagagacatgattcattgccagatcttcccataacaccttctagagaacttgtcataccctcagcttttgagggtaagccctaaataccatgtgagtgtgctaccataaccccaacccaacacctctcaccggccctacctcattatttattgaccaagttaggaataaatacctgagatatgcttaagcaatccattagctagcaaaaaatcattcagattctctctcaagaatctgaactaacacaccaagttagctattttggggagcaaacccaagttctaaagtgcagcaaccaagagaaagcaggccaatccagtatatagaaaaaagtagagcaaatacacaaagattagaaatcacatagcatctgaaatacgagggaagcaaactcaggctccaacaatctcaatgacactagggttagttgaactcaaaaggatttttgtgtatctttttattttatgtagcttgatggatctctgttcttacaaccaaagatatttatctaaattctattcttctggttataactttttgccttggcataatattaaacttaaagaaaagttgcaataatagcacaaggaactcccacatgccctttacccagatttaccaattttttatattttgccctatatgctttgtcattttatgtctatatctacctctctatatatataaatgcatacatattacttcctcaattatttgtaaattagaagcatcctgcctctttatccctaaaaacttcaatatatatttccttagaacaagaacactgtctttgataaccaaagcgtggttatcaaattgaggaaatgtaatattaacacaatgatattatctactgcacagtttatactcaagttttacaaattatcacagtaatgtcatttatagctattatttttcataatccaggatccaaccaagaatcacgcattgcttttagttgtcacatcaactatttatttctcctttaatctggaacagcctttcttcgtgtttagtgaccttgacattttttaagagtacagaccgttattaaatgtctctccattaggatttgtctgatgtttcctcatgactaggtttatgagattttggcaagaatgacactaaagtgatactgtgtcctttttcattgcatcatattagaaggaggctagtttgtcccaatatctccaatgtacagctcagtaacttggttaagacagtgagcaccaagttactctaagggtaatattacaaagaaagtctctccactgccatccttttaaaaagttaagagtatctcatctctggaaactcttaccttgatgctacagaatacctctatatttccaccctgtactctaaagtagaaatcctggatgtattatgtacaactagggcatgatgcctgatgaaacatcaggattagaatatagaaacaatcttgctactatattatataaagacagtataaggatgcagatttagatatagatgtagatataaatatagatatgtacctatgtgttcatctatatagtctgaaattgaaaaacatttctaattagtttgacctccaaggaagcctgacttcaaaaaacatttaagttttctttttctgacatcagaatatacattatcaatttcaaatgtaagatgtaaaaattaggcttgcagatctacttcaggctataatgaagcagggtaccacactaacctcccactgttaaccataaaatgggataaaatatatgagataaccattctcaagtattggacaataggtaatgcagtactgtgatcctcaagaattgaagaccacgatagtcccaactttccgcctgggtacaacaactggagtccatgtggagcaccacaggcctactgagctgagaaagcagaggtcagagttctgagcagttaaagaatcttaaatgcagggtactaaaagaggtataagcttcccagaagatttccctgtcactcctcaaccacaggctgatggctgggatgtgtgcaccctgggtgaataacaaaacattactgctacaaagtagaaaatgtaacagctgctacaggttaaagtgctgggaagcaccaaagacctgcccagccaggtggagacagcttcctaacaacttgcaaatacctgggaattcagctgaaacaacataaaggccacaccttaggactactctaaacctacctacaaggactgaaagcaagcctcagaaagatagtttgtaagacaggtcccatggtgttggataatatctttggctttctatgtatttgccttaacagaatgtaaaaaccaagtctacacaacttaaaggtgattaactagtaattgaacagcctataagaacaacaacaacaaaaaaattctatggagaaaaataacagaatccagagtccctacaaggtatcaaccacaaggtcctttatctagaaagtaataaagatgcaccaaaaaaataaaaaagaaaagaaaattttgtccttaggcaaaatcaatataaataaataagttaataaggcccaagatgactctacttcagcacaccacagtttaaagaagttcatataaataccttcaaagaactaaaggaaaacatattcaaaaattaaaggaaaatattattttaatgaaagaacggataagggatctcagcagatagatggaaattataaaaaggaaacaaatgaaaattccagaatcgaaaagtgcaataattcaaaggaacaaaaattcactagatgagcttaatggattagagagaacagataaaggagtctgtaaatttgatgacagaacaagagaaattatctgacagaaaaaaagattgaagaattgatttttaaaaatcaataacactttggaaactgtgaaacaaaatccaagagtctaatatacatgtaattggggttcctatagaagcaaataagaatagggaaagattatttaaagaaataatggccaaaaatttcccaagtttgataaaatataaaaatactgacttagagaacaagatgctcaatgaactctatgcaggataaatgcaagaaaacaacgcctagaaacatcacaaactgctgaaaaacaaaaacaaaaagaaaaatcttggctgggcatggtggctcacacctgtaatcccagcactttgggaggccaaggcaggcagatcacaaggtcaagagttcgaggccatcctggccaacatggtgaaaccccgtctctactaaaaatacaaaaattagctgggcgtggtggcacgtgcctgtagtctcaggtactcaggaggctgaggcaggagaattgcttgaacccaggaggcagaggttgcagtgagccaagatcgtgccactgcactcaagcctggtgacagagtgaggctctgtctaaaaaaaaaaaagaaaaaaaaaaaaaaagaaaaatcttaaaagcagccagaggaaaacaggcattacattcagagaaacaacaggctccccaacagaaacaatggaaaccagaggacaaaggaataacatcttagaagtgctaaaagaaaaattcagatgacttaactcatcaccagtagaactgcactaaaacaaatagtaaaaggtattcttaaagatgaaaacttagaaactctgaaatgaaggaaagtactagaaatagtatgtgagcagagatacataaaagccatttttatcttctcacaattccccaaaacacaactatttaaagataatacaacaacctcaaaagttaggtttcataaggtatttagaactatgacaatagcacaagtgattgtagggttaaattagattatactgttttaaagttattagatttatgaggtggaaattagaaaatgggaaaagtccagtgtaagcggcacaatattgacactaaaaattgactttgatatggtaaggatgcataattttagcccaaaagcaaccaataaagaaaacatacaaagggaaagtatagccaagaagtcaatagaaaaattaaaatagaataacaaaaaaataactaaaaataaggcaagaaaggagcaacagagtagtgaaaaataaaaaaagggggtaccagtggaaacgaacaccaacaaggtagattaaacctaaccatatcgatcagtaactatattaaatttaaatggactaaacactctaattataagagactgttaaaaaattagcaatgggatcttgaatgggaatcattatggtggatgagaggcatgaggactagattgcagctccaactcggacagacagagcagtgtgcagaggcttgcatcatgaattttagctcaagaatgactgcaagaatgaaccaggaaccccgaggggacccccagaccctctgaaggaagaggactgctcctgcaggacgcgggagacaccccaaatactgtgagttcccaaactgcagaagtgggaaagggagaccctccattcccaaacacacacccccactgggaaaactcaaggtctggtttgcaggagacatttccgaccttacccacagctgggtcaatttagagggctgagtgaaatacaggggtagaggaagtagtaggaaaggccctgggagctcgctgggtccccaagcaggccattcctgcctggtaccacagggaccttttgcgagggcagctagaggcatagggggaaataccacagagagaaggaagtctccagctgaactttgtaacaatttgaactgggcgagaaggctctgggccagaactcagagaaaggtgcaaacccagtgtgcagactccacaggcggcggggtaagaaccaaagccctcttcttttgcagctgggaactaggtagcctggggcaagttctccagccctgctcacccactgcctggaaatagactcggggctgctagggggacatggtgggggtgagaccagccctgaagactgtgtgggagctgggtgagagctgtgactgccagccttccctcacttccctgacaacctgcatgactcagcagaggcagccatattcctcctaggtacacaactccattgacctgggaacctcacccctatcccccacagcagccacagtaagagctgcccaaggagagtctgagctcagacatgcctagccctgcccccacctgctgggccttccctatccacactggtagctgaagacaaagggcacatactcttgggagttctagggccacgtccaccactggttcctctccatagtaccacagctgatgctctctggaaagtgtcaccctctggcaggaggccaaccagcacaaaaatagaactgtaaaccactaaagctaagaaccctcacagagtccatttcaccctcatgccacctctaccagaacaggtgctggtatccatggctgagcaattcatagttcacatcacaggactctgtgcagacaacccccagtaccagcccggagccaggtagactcgctgggtggctagacccagaagagagataaccatcacttgcagctcagctcacaggaaaccacatccgtaggaaaagggggagaatactacatcaagggaataccccgtgggaaaaaagaatctgaacaacagccttcagtcctagacttttctcagagcctacccaaatgagaaggaatcagaaaatcaactctgataatatgacaaaacaaggctctttaacacccatcaaaaaaatcacactagctcaccagcaatggatccaaaccaagaagaaatccctgatttacctgaaaaagaattcaggaggttacttattaagccaatcagggaggcatcagagaaaggtgaagcccaattcaaggaaatccaaaaaaacgatacaagaagtgaagggagaaatatttaaggaaatagatagcataaagaaaaaacaatcaaaacttcaggaaaacattggacacacttagagaaatgcaaaatgctctgcaaagtctcagcaatagaatagaattgaacaaaaagaagaaagaaactcagagcttgacgacaaggtcttctaattaacccaatccaacaaagacaaagaaaaaagaataagaaaatatgaacaaaggctccaagaagcctgggattatgtgaaacaaccaaacctaagaacaatcggtattcctgaggaagaagagaaatctaaaagtgtggaaaacatatttgggggaataattgaggaaaacttccctggcctttctagagacctggacatccaaatacaagaagcacaaagaacacttgggaaattaatcacaaaaagatcatcacctaggcacactgtcatcaagttgtatattctggttattagtccattgtcagatgtatagattatgaagattttctcccactctgtgggttgtctgtttaccctgctgactgttccttttaccgtgcaaaagctctttagtttaattaagtcccaaccatttatctttgtttttggggttcttgttcatgaaatccttgcctaagccaatgtctagaagggattttccaatgttatcttctagaatttttatagtttcagttcttacattaagtccttaatccatcttcattgattttcatataaggtgagagaagaggttccagtttcattctcctacatgtggctagccaattatcacagcaccatttgttgaaaagggtgcccctttccccactttatgtttttgtttgctttgttgaagatcagtgggctgtaagtatttgggtttatttctaggtcctctattctgctctattctgtgcttttgtatcttttttttttcttttcttttctttttcttttttttttttttgagacggagtctcactctgttcccatgctgaagtgcagtgacacgatctcagctcactgcaactctgcattcctggttcaagggattctcctgcctcagcctcccaagtagctgggactacagacatgcgccaccacgcccggctaatttttgtatttttagtagagacggggtttcatcagattggccatgatggtcttgaactcctgacctcatgatccacctgcctcagcctcccaaagtgctgggattacaggcgtgagccactgtgctcgggaagttttatatcttttatgtggagcatttaggccatttacatgcaatgttagtattgaaatgtgaggtaccattgcattcatcatgctctttgttgcctgcatactttgggttttttttaatttttgtttttgttttttaacttgtatttttgttttacaggtcctgtgtgatttatgctttaaagagattctgttttgatatgtttctaggatttgtttcaagatttagagctccttttagcacttcttgtagtggtggcttggtagtggcaaattctctcagcatttgtttgtctgaaaaagactgtacttgtctttcatatatgacgcttagtttcactggatacaaaattcttggctgataattgttttgtttgaggaggctgaagatagggccccaatcccttctagcttgtaggatttctgctgaaacatacgaggggccaacgaacatatgaaacatcactaatcatcagagaaatgcaaatcaaaaccacaatgagatgcaatttcacaccagtaagaatggctattactaaaaggacaaaaataataataataatacttaacatactggcaaggctgctaagaaaaaggaatgctgcggggcacagtggctcatgcctataatcccaacactttgggaggctgaaatgggtggatcacctgaggtcagtagttcgagaccagcctgatcaacatggtaaaaccccgtttctactcttgcatatgtatatcaggatacacacacaaggttattcatagaattattatttgtaaaggcaaaaaattagaataaagtttatcaaaaaaggcaagaaatatgacattcattaaatagaaaacagtgcaaacaaacctattacaactatatggcacaacaatgcctctaacatactattgagcaaaagaagcaagacataaaagaatatgaaaagtttagttctctttgaacacaaacaaatgaaaaaacattccatgctcatggataggaagaatgaatattgtgaaaatagccatactgcccaaagtaatttatagattcaatgctatccccatcaagctaccattgacttttttttcacagaattagaaaaaactactttaaatttcatatgcaaccaaagaagagcccatacagccaagacaatcctaagcaaaaagaacaaggctggaggcatcatggctacctgacttcaaactatgctacaaggctacataaccagaacggcatgttcctggtaccaaaacaggtatatagatcaacggaacagaacagaggcctcagaaataacgccacacatctacaaccatctgatctttgacaaacccgaaaaaaacaaacaatggggaaaggattccctatttaataaatggtgttgggaaaactggctagccataggtagaaaaatgaaactggactccttcctaacacctcatataaaaattaactcaagatggattaaagacttaaacataagatctaaaaccataaaaaccctagaagaaaacctaggcaataccattcaggatatagacatgggcaaagacctcatgactaaaacaccaaaaacaatggaaacaaaagccaaaattgacaaatgggatctaattaaactaaagagcttctgcccagcaaaagaaactatcatcggagtgaacaggcaacctacagaagggcagaaaatttttgcaatctatccatctgacaaagggctaatatccagaatctacaaggaacaactttacaaatttacaagaaaaaaaacaaacaaccccatcaaaaagtgggtgaaggatagaaacagacacttctcaaaagaagacgtttatacggccaacaaacatacgaagaaaagctcatcatcactggtcattagagaaatgcaaattaaaactacaaggagataccacctcacaccagttagaatggccatcattaaaaagtcaggaaacaacagatgctgggaggatgtggagaaatagggacacttttacgctgttggtgggagtgtaaattagttcaaccattatggaagacagtgtggagattcctcaaggatctagaaccagaaataccatttgacccagcattcccattactgggtatatacccaaaggattataaatcattctactataaagacacacgaacatgtatgtttattgcagcactgttcacaatagcaaagacttagaaccaacccaaatgcccatcaatgatagactgaataaagaaaatgtggcacatatacaccatggaatactatgcagccataaaaaaggataagttcgtgtcctttgcagggacatggatgaagctagaaaccatcattctcagcaaactaacacaagaacagaaaaccaaatactgcatgttcttactcataagtgggagttgaacaatgagaacacatggacacagcgagaggaacatcacacactggggactgtcagggggtagggggctaggggagggatagcattaggagaaatacctcatgtagatgacaggttgatgggtgcagcaaatcaccatggcaagtgtatacctatgtaacaaacctgtacgttctgcacatgtatcccagaacttaaagtataataaaagaaaaagtaaaataaaataaaaaataaaaataaataaaaagtttagttctcttcatataaagttcaaaatctggtaaaataaaaatatttcaattttcaaagatgcaggtattaatgctaaaatcaatattaaaacaaataggtgaaaattatcatcagaaaaatcagaatagtggttacttctaggaaagatggaagagaatatgattacaaatggtcagacagcaggcttcttaggatattggcaattatctaattcttgcctgggtggcatttacaatggcatttctttgtacaattatttatcaaattatgtgacattatgcatatctgaatgctatgtttcatatgaaatctataacagttctgtcatttattatgtcaataactgtggctttctttatcctagagttatttaaattatatatttgactagcagactcacagacaaaaaaaaaaaaaggcctaattccaagcgcagtggctcacgcctgtaatcccagcactccgggaggccgaggcaggtggatcacaaggtcaggagttcaagaccagcctggccaacatggtgaaaccctgtctctactaaaaatacaaaaattagccggacatggtggcacgcatctgtagtcccagctactcgggaggctgaggcaggagaatcgcttgaacccaggagacagagattatggtgagccgagattgcgccactgcattccagccttggcaacagagcaagactccatctcagggggaaaaaaaggcctacttggcattacacataataaagaagcaacatctctttttaggcaatagatggaaacattcaatatgggtgaaaagaaaggtcaaaggaaattttctattttatttcacaaaaagagtaattttttactccggtttctcttcagattgtataaatctttcgccttttaccaaaggagcaatttctaccatctgttctctgaaaaattgacctcttcttgttgtgttgtctgttctttcattttcagtgagaaaacttttccaaatgtcataatgtcaaaaagcctttcttcagattactaaaaaaagaaagaaagaaagaaagacccgttgcttgatgatgctcactgtcacacaattctgtgatgtggatatcagagaaaatgtgttagcaattacaaaggcaagcaagtccaagtatgtttgtgaatgataggctaaagttaaaataaaggatcactgtcactgaacatgttttcccataacatatgagaaatatgcccaaaataaattgaaaattgttaagaacatcttaaaatatttaatatgtgggtcaggtgcggtgcctcatgcctataatcctagcactttgggaggcagaagcagtggatcactttaggtcaggagttcgagaccagcctggccaacatggcaaaaccctgtctctactaaaaacataaaaattagccagatgtcatggcgtgtgcctgtaatcccagctacttgggaggctgaggaacaagaattgcttgaacccaggagacagaggttgcagtaagccaagactgcaccatcgtactccagcctgggcgacagagcgagactctgtctcaaaaaaaaaaaaaaatttttatatgtgtatctgtagccaccaaaacaaaccactataattctttaactccaataaaactagatattaatattaatattaatattaattagtaaattaggttaaataaccattaattctattagtaattttacatattttactcatgttaacatctaagtatcttctgaacaatatgaatttaaaatggaagttgtattttattaaatagctccatttctaaaggctaaatattttaagactcactaaaacttcaacaaaattaaatactttaataaatccttcatgactgatatggtttggctgtgtcctcacccaaatatcatcttgaactgtagctaccatcattccaatgtgttgtgagagggacccagtgagaggtaattgaatcatggggaaggattttcctcgtgctgttctcatgatagtgaataagtctcatgagatctgatggttttataaagggcagtttccctgcacatgctctcttgcctgccaccatgtaagatgtgcttttgctcctcttttgccttctgccatgattgtgaggcctcccagccatacagaactgtgagtccattaaacctctttttcgttataaattacccagtcttgggtatgtctttattagcagcatgagaacggactaatacaatgacacagataaactctataatctgtaaaaaattggtatcaattaattatctccagacttactggatcctttaatataagtatttcaaactcctaaatttttattttataccattaagaactgactaatgaggtcaggcgcggtggctcacgcctgtaattctagcactttgggaggccaaggtgggcagactgcctgagctcaggagttcgaaaccagcccgggcaacacggtgaaaccccgtctctactgtaaatacaaaaaaattagccaggcgtggtggtgagtgcctgtagttccagctactcgggaggctgaggcaggagaattgctcgaacctgggaggcagaggttgcagtgagccaagattgtgccactgcactccacactccagcctgggtgactgagcgagactccatgtccaaagacaaaacaacaaaaaaagaactaacatagattactatcagtatttacagcaaaacctctgaaagagatctaatatttaaatagaaaaataaaatttttaaatagacaaaaaagaggtaattttttgttatgttggaaggtgaaaggcttttgtaagcataatacaaaaaccagaagcctagagaaaaggctgacagatgcaactatttaaaaggaaacttctcatgcatatcaaaactaccaggagatatcatttcagtccagttaaaatgccttttatccaaaagataggtaataacaaatgctggcaatgatgtggaaaaaagagaacccttgtacactgggttggtgggaatgtaaattaatacaaccacaatggaaaacagtttggaggttcctcaaaagaaaataaaaatagaactaccaatccaccaatcccactccaaggtatatactccaaaaaaagaaaatcagcatattgaagagatatttgcactcccatgtttattgcagcactaataacaatagtgaagatttagaagcaagctaagtatccatcagcggatgaatggataaggaaaatgtggtacacatacacaatggagtactacccagctattaaaaagaatgagatcctgtcatttccaacaacatggatggaactggaggttactatgttcagtgaaataagccaagcacagaaagacaaacttcatatgttctcacttatttgtgggagctaaaaattaaaaacaattgaactcatggagatagagagtagaatgatggttattaggggctggaaagggtagtgggaaggcagggggggagttgggatggttaatgggtataaaaagtagaaagaacgaagaaacctataatttgctggaacaataaggtgactacagtcaaaaaaaaaatttaattgtacattttaaaacaactaaatgagtatagattgtttgtaacacaaaggataaatgcttaagatgatggataccccatttaccctgatgtgattattatgcattgcaggcctgtatcaaactatatcatgtaacccacaaatatatacacctactatgtacgcacaaaaattcaaaattaattttaaaaagttaaaaatagaagaaaccttctctacactaaaaagtagcacaaatcaaaagatattcacagagaaaaatatttgtaagacatacaaaaaagaagtgatactttaacatgcaaattgctcgagtgttaataacaaaatggaaaaagaggcattctctataccattaatgttaacttaaatagacataacccttcttaagttttactgaaatataatttatatatcataaaattcacacatttacacaatacaaatcaaaggtttttaatataacagagagttatacaaccgttagcacaatctaattttagaacattttaatcatcctaaaaagaaactctatatccactagccaatactccatacactcccatgcctgcagccctatgcagacataaccttattttaaggacaacttgtcaacgtcaatctaaaatgcaaatgtgccatcctgtgactgagccattccatttcacatcatttattctgcaagaaaagacacataatacacaaagatatgcataggggtattcttgaaataccatttgttatagaaaaatactctaaacagcctacatgcatcaatagcaaattatattcataaaacatgatgtatcagtaaagtaaaatttatgtaattatgaataagaatggggtgatatttctgatatggaaaaaatcatcagaatatatatgtcagtcaaaaagcaatgaaatgggctgagcacggtggctcacgcctgtaatcccagcactttgggaggccgaggcaggcggatcacgaggtcaggagtttgagaccagcctgaccaacctggtgaaaccccgtctctactaaagatacaaaaaatagccgggcatggtggcgcacacctgtaatcccagctactcaggaggctgaggtaggagaattgcttaaatccgggaggtggaggttgcggtgagctgaaactacgccactctactccagcctgggtgacgacagagcgagactccgtctcaaaaaaaaaaaaaaaaaagcaatgaaatggtctatatacagtatatgatctaattttacttaaaaagaaataatcctagagaattttaaagagaatacccattaaattttcagcaataattatctctgaagaatgagttgagaaagggatgattaaatacttgagagctaatatttaattttaaataaagttgactcacttaaaagaatgctatttattgttttaaaaatattacccagcaacaataaaggcatttttagatgagaacatgcacaagagttgttttatagggacatgtaaggctctaacaaacttcgaaacagaacagcatttatcctcatgccaacaattaaatgttgaataaaagggatttaagcaagtagacataagattttcttttctttttttttttttttttttttttttttttttttttttttttgagaaggagtcttgtgctgtcacccaggctggagtgcagtggcgtgatctcggctcactgcaaggtctgcctcccggggtcatgccactctcctgcctcagcctcctgagtagctggaactacaggcacccgccaccatgcccgagtaattttttgtattttttttagcagagacggggtttcaccattttagccaggatggtctcaatttcctgacctcgtgatctgcccacctaaagtgctgggattacaggcgtgagccaccgtgcctggccataccaattttcttaaggaaaacatatgtttatagaacacatagagaaaagaaaaaaaaacgtaaatatattaccagtattttttatttctaggtgttgattctataggtgattttatttccctccttacatatgtctctatttcccaaaatgtctttaataaaaatctacataatttattttataatcagacatgctactttaaaagatagatgaaactaagatagtttttacacaggggcaaatcagcagatacttttaaatattgtgcaatggagaaaaatatgataaaaaaacttcatcaaaataagtcagaaatgactgtaattgcacaaaggattattttagaaaaatgtacactgaatatattttaatatatggaataagtttatgattacatgcaaacttctcaatgatgcctcaaatatttttatagtatgcccaaaagaaaaacagaaacataaggatttaggaaaaaataaagtcaaacacatttaaaaatgaatttctgatgcaatgcatgatagctttaaatgttttttctttgaaaacatatgtgggtggcattggtatgctgactcctgccccaagttgtcatcaacaaaatttttaagtgatgatttcctttcaattcatttaattatttatggtaagcagtctcaacagtaagaattaatacaaaataaaattaaaagaaaaaatagttgggaatgactcaaaatgatttttataattcatgaatgacaatttttagaaaaagaaattcaaaacaagagctcaaaggacaaatatgctttttaaaatgtcatttgtttttatttcaacagtttttgtaacaccaggattatacaagaaagaaaagcctgagtctaatgtcagcaagatggcagactaggactttcaagccctcgtccctccacagaaaaatcaatttgaacataaacatgcacaaaaataccttcataagagctaagtaaacaaggtgaaatattacagcacgaaataggaaaagacataacgcagaatgtagaaaggacagttttactcagaagtccgaggctgcaggttttaaaatactcacatcacccctcccccaactccagacagtaaagcgtggagagaccctccacttgggaggagggaagaaaggtgagcactagactttacctcagacctcaataccaggtcagtcccagtaaaacgtaggatcaggcaggactcctcagccctagactcccagccagtaccccaggactgaccctgcaaatccaccctggtacaaggaaaaatctcacagccccaggctccagactggcccagtagatttagtccctgggtccacctcaccccaccccatgctgataccagcagccacagcatccaaactaaccctagtgctggactgaccccagcagcctaaacttcagctccaccccagagccagaccagcccctacagactaaggttcctggctagcctctgtagccccaggctccaggtcagctcccaagacccaagactccaggccagtacccacagactgagcctctaggcctaatttggcacaatgcaagatcccacagccccaggttccaaagccagcccagcagactcagtctctggactcaccacattgccaggcgggcccagtgaccttgggctccagactattcacagcacgaggctggccccgacaacttcaggtttcaggcctacccaggaaccaggccagcctccagaatccctagtcatcaggccagcactcacagactcagcctccatgctggcccatgtgaatataggctccagacatacccaatgtcaggccagcccatctggccccaggctccaagcataacgcaggattcagagccaggtcagccaacacaaccccatgctttagacccacccaacctcccagtcaacacctctggcccagactccaggtcggccactggggccccaatctccatattaacccctgtggtcccatacaccaggagactcagggtctagacctgactaacagacccagggtccaggctcatcccaataaactgtggtgccaagccagccctcagaaaataagattccaggtccatccctacagaatcgtgacccaggcccacccctgcacactcaggcccctggcctgtcccagtggaccaaagaaccaggtccatcccagaacctgtctggcccctgcagattcaggcttaaacccaccctagaaccaggtcagcccttgcagacctaggcttcaggctagccctggtggatacatatttcaggcttaccatgcagacccaaactccaagctcactcccatggaccaaagcaacacatctacccagtggatccaggctccaagctcaaacatgaggaccaagataccaggcccacccactttctgaccctgcctggggactgtaggagagagcccaccaataggccaaacagcctgcccagaatctctggataggctcaatgatgactggctttctcaaatgaagccagtctacaaagactataataatttcctacttcttcaaatgtgcagacaccaacataaagcaacaagcaacataaaaaaccaaggagacataaccccagcaaaagaaaataatctcccaatagctgaccccaaagaaatgaaaatatataaactgcctgacaaataattcacactaattgttttaaggaagcttagtgagcttcaagaaaatacagagaaataatttattgaaatcagaaaaacagtaagtgtataaaatgagaaatttaacagagaaattttttaaaaaatcaaattctggagctgcaaaatataacgaatgaaaagaaaaatataacagcattcacaactgaattgatcaagcaaaagaaaaaattcagtaaactcaaatatacaggttattagaaaatatgcagtcagagaagaaaaaggaaaaagactggaaaggaatgacgaaagtttacaggacgtatgggacaggatcaaaagagaaaatattcaagttataggagctaaagaagaaaaagagagacaaaggtgtagaaagtttatttaaacaaataatagctaaaaactttccaaattgagggaaagatatatatatcctggtacaaaaaggtcaaaagtctccaatctgatttaattcaagcaagactataccaagccatgttataatcaaactgtcaaatataaagaacaaatggaagattctgaaaatatcaagagaaaagcaaattatatacaagagacttccaataagactagcagcggatttcatggaggaaatcttacagtccagaaaagagtaggatgatatattccaagtactgaaagacaataactgccaaccaagaatattgtgagtggcaaagcagtctttcagaaataaagaaaagttaaaaatgtaccaagacacaaaaaagccttagggagttcatgaccactagacttgtcttacaaaaatgctcaagtgaaatcttgatgctcaaagaagaagacactaatgaataacaaaaaatacatatataaggataaaactcaccagtaaaagtaaggaaacaatcaaacacagaatagtctaataatataatgttgtggaaatgacttatatctttagtatgaagatattatattatttaaatataatagccacaataatttctttctatacaatataaaaagatgtaaattgtgtcatcaaaaaatgaaacagagtaaaatgtagtttttatatgtgataaatcaaggttattatcagtttaaaatagcctgtcatgaaaataagatgttttatgtaagcctcgtagtaatcacaaagcaaaaacctacaatagttgcacgaaacataaaaagaaaggattcaaagcataccactacagaaattcatcaaatcacaaagaaagataacaagacggaaaggaacaaatgttctataaaacaaccagaaaacaaattacaaaacagaagtagcaagtctttacttatgaatacttatgttgaatacaaatggattaaattctctaatcaaaagacagaataactgaatggattaaaacaaaattcaactatatgcttcctataagaaattcatttcatgtttaagaacctacatagactgaaagtgaaggaagaggaaaagatatctcatgcaaacggaaatggaaagagcgagggtagaaatacatcagataacactgacttaaaatcaaaattataaaatgagatacaggtcattatacagtgacaaagggctcaagtcatcaaaaggatataccaattataaatatatatgcccccaaagtaacatcacctaaatatataaagcaaatattcatagatataaaaggagagaaggagtgtaatacaataatagtaggggactttaagaccacaatttcagcaacggacgggttacccagaaagaaaattaataaggaaacatcagatttggtctattctttagtgcaaataaacctaaaagagatatacagatatacaaaatgtaccattcagtggccacagaatacacattcttctcaaccaaatgtgaaatattcttcagcatagatcatatgttagttcacaaaagaaatcttcacaaatttaagaagactgaaatcatatcaagtatcttttctgaccacatgtttaatactagaaatcagtaacaagaggaatttcagaaaattgacaaatacatggaaattaaataacacactcttgaacagctactatgtcaaagaagaaattaaaagagaaatttaaaaatatctacagacaaatgaaaataaaaacacaacatacaaaaacttatgggatacagcaaaagcagttctaagaaagaagtgaatagcaataaatgcctacatcaaaacaggagatctcaaataaacaagttaatgttacacctaaataacttctaaaagaacaatctaagtccaaagttcacggaaggaaggaaatcataaagatcagagcagaaataaatgaaatatagactagaaaaacaatagaaaaggtcagtaaaattaagagttagttatttgaaaagataaacaaaattgacaaaactttagctagactaagaaaaaaataagagaagacaaataagtaaaataagaaatgaaagagatgttagaattgatgccacagatatacaaaggatcatgaaagactactatgagtaattatacgtcaacaaattagatagcctacaagaaaggaataaattcctggacacacagaacgtatgatgactgaatcatgaagaaataaaaaagctgaagaaatcaataataagtaaggtgactgaagcattaatttatgtatttacttttttttttttttgagatgggagtcttgctctatcacccaggctggagtgcagtagtgcgatcttctcactgcaacccccacctcccaggttcaagcgattctcctgcctcagcctcccaagtagctgggattacaggtgcacaccaccacacccaactaatttttgtatttttcatagagatggggtttcaccatgttggcaaggctaatctcaaactgctgacctcgggttatctgcccacctcagcctcccaaagtgctgggattacaggtgtgagccaccgagtccggccttgaagcattaatttaaacacacacacacacacacacacacacacacacagatacacacacacacaacatatgcccaggacctgatggcttcactgttgaattctaccaaacattgaaagacctaataccaatcctcctcaaactcttccaaaaaaaacagaatacttccaaactcatattatgaggccaactttacactgacaccaaaactacacaagaaaacaacaagaaaggaaaattataggccaatattaaggatgaagatagatgcaaaagtcctcaacaaaatattagccaactgaattcaacagcacactcagaagagcattcaccatgatcaagtggaattcatcccaagaatataaagatactttaacatatgcaaatctatacatgttgtacaccaattaacagaatgaaggataaaaaccatataatcatctcagtagatgtggaaaaagcatttacaaaattcaacatattttcataataaaaacaacaaattaggtatagaagaaatgtacctcaatacaataaaggccatacatgaaaaacccattgataacaatatattcaacagtgaaaaactgaaagcttttcctctaagatcagaaatgagacaaagatgtccactctcactacttcttttcaacatagtactggtggtcctagccagagtattacacaagggaaataaataaaagggtggccaggcacagtggctcatgcctgtaatcaatcccagcactttggggcgctgaggcaggcagattacttgaggtcaggaattcaagacaagcctggacaacatggtgaaaccttgtctctaccaaaaaaataaaattatatatatatatggcacacagtggcaaatgcctgtaatgccagctactggggaggctaaggcaggagaattgcttgaacccgtgagacgtaggctgcagtgagctgagattgcaccactgtactccagcctaagcaacagagcatgactgtctcctaaataaataaataaattgtatccaaattggaaaggaacgagtgaaatggtctctatttacagacgatatgatcttatatgtaaaaaaaaaatttttaaagactccaccaaaatgctggaactaataaatgaattcactaaagttgcagaatacaaaatcaacatacaaaaatcagtagccattttatacactgacaatgaactatacaaaatcaagaaaacaatccctctcttactaggtaccaaaaaaaaaaaaccacttagaaataaatttgatcaaggagattaaagaccagtataatgaaaactgtaaaacactgataaaagaaattaaagaagatacaaataaatggaaagatatctcatgttcatgaactggaagaactaataatggttaaaatgtccatgctatccaaagcaatctatatatttcatgcaatccctatcaaaattccaatggcatttttcacagatataaagaaaaccctaaaatttatatgaaactaaaaagaccctgagtatccaaggcaattttgagcaaaatgaacaaaggtgaaggcatcacactacctgacttcaaaatacactataaagctacagcaatcaaaagagcacagtaactggcataaaccagacacacagacctaatgaaacagaacagggaacccagaaataaacccatacatttagtgtcaactgattttcattattattatttttatttatttatttattttgagatggagtcttgctctgtcacccaggcaggagttcggtgacacaatcttggctcactgcaacctctgcctcccaggttcaagcgattctcccgcctcagcctcctgagtagctgggattacaggcatgccctaccacacccggctaattttcgtatttttagtagggatggggtttcaccatgttggccaggctggtctcaaactcctaatctcaagtgatccgcccacctcagcctcccaaagtgctcaattacaggcgtgagccaccatgcttggccaggtcaactgatttttgacaaagatgccaagaacacacaatggggaaagacagtgtcttcaataaatgatgcttggaaaactggatatccaacatgcagaagaatgaaattagacccttatctcacaccatatacaaaaatcaatttaaaacagagacttaaatgtgagacctgacattttaaaactactataagagaaataggggaaaagctccatgacattgctctgggcaatgatgttttggatatgaaccgaaaagcatagtcaacaaaagaaaaaatagacaaatgagattatatcaaactaaaaagcttctgcatagcaaaggaaacaatcaacagagtaaaaagacagcctacacaatgagaaaaatatctgcaagccatatatctaataaggggttaacatccaaaatatatatggaactcaaacaactcaatggtaagaacactgataacctgattttaaaatgggcaaaggatctgaatagacattcctcaaaagaagacacgcaaatagccaccagatatatgaaaaactgcccaacaatcctaatcatcagagaaatgctgactaaaacaatactgagatatcacgtcacacctattagaacggctatcaacaaaaagaaaaaagatcagtattggaggggatgtggagaaaaaagaacccttgcccagtgttggcagtaatgtagattagtgcagccattatagaaaaacagtacgagggttccttgaaaaattaaaaatagaactactacatgatccagcaatctcactattaggtataaatccaaaggaaatgaaattgctatattgaagagctatctgcacccccatgttcactgcagcaatagccaagatatagaatcaatataaagtgtccatcaacaaataaatgaaaaaaatgtgatatatatatacacatacacacacacacatacacacacacacacaatgaaatgttattcagtttttaaaaagaaggaaatcttgtcatttagtacaacatggatgaacctagagaacacgatgttaagtgaaataagccaggcacagaaaggcaaataccacatgatctcacttatatgtggattctaaaaaaggtgaactcacaaaagtagagaaatggtggttatgaggccaggcgacaaggagtggagttgggagatactggtcaaaggatacaaaatttaagttagatgagagaaataagttctagagatctattgtacagcatagtgactttagttaataacaatggattgtatttcaaaaatcactatgagagtacattttaagtattctcattacaaaaaataatgataagtctgtgaggtgattcatatatcaagctcaatttagccatttgacaatgtatacatatttcaaaacatcatgttgtacacaataaacatctacaattttgtccaggtgtggtggctcatgcctataatcctaatgctttgagaagtcaaggtaggaggaggatcacttgaggccaacagctcaagaccagcctgggaaaaacagtaagatcccatctctaccaaaaaaaaaaaattttaattagctggacatggtggcacagctgtagtcctggctactcaggaggctgaggtgggaggactgcttgatcccagtgagctctgatcacaccactgcactccagccggacaaaagatagagactctatctctggaaaaacaaaaacaaaaaacaaaacagaaagatgaaccctgcctaccatgcatcatgttttatatttgtttcaagtgcaacctcttcctagaatataccattattttaactaaaacctgaaaacctagattacataaaatattaaaactgtattatcaatgggtttatcagcaatatctcattcctacctctttctcacgtattcgagagagaaaatgatcatcatggaaactgctggattttctcaggctgaatttcggtgtcatctgctaaatgaacaggagttatttaacatgttttcagatctggtttatccttaaccccaaagaaaacttctaaattgcctgaggcccgtaccaaaatagtactaacactgcaggaaaaaatcacttccaagtgataaaattcaaaaactattatgtttcctaatgtagatccgcattattttctataaataacttagtgattattttattttaaaatacctgcccctagaaaaagtccaatggatttctcacataccagagaaactgggataggcttctgtctcaggtatcgaggattttctatctgaaaatttaaaaataaaacaaaataaggatttattaattttggagttttaattattatttgataaaatatagaattaagctgccatatgaaacattttctagattcttaatatttaattcatttttagaatgggtattgtatgatatatttttagcggctccctacaagtaaaatataaaacataaactcccttgcatgccaaaatgaaccttcatgatcctctcactgcctaactgcccactctcatcttccattacccttcacttcacattttatgctcccaggatccacaatgatttatattaccagaacatggcagatgttctcatgcctgtccacctctgaatttctctgcccagccctccaaaccctgtaagcacacacctatttgttcttacagtcgcaatttaatcactgcactcccagatgtatttggtacatgaattcttaaacatacctttctaatagcaaagagaacacaaaattcctttgggactccccctaaatctccctttcagattcatctatcttcaccataccccacattccaaggacaccagacaatttgttttaacttaaaagcactatactgtctcccatgtctgagtctttgcaacctgtaagatcattcccccaacttctacacatggttaacttactcaagacttgtagtttaaaaatcatctcccccaggaaacctagttcctactactccagtagtaccctggatgctagttcccttttacaatctggcatctccctgtttcaaaacagtgtggactctgaaagcagagaccatgactgccctgttcaccactctatccctagcacccaactcagtgcccaattaatatttcttcagaaagaaggaagaaacaagaggaaagaaaggagtaacctgtacctgattccaccttcttatcagctcctaaagtatcctatgtccactctctcatagcccttatgtaatactttgagtgtttatcagtatgtctccacatctgtctttgaacagaaggagtactgggatgacatcttctcagttttgtatctctgggacctagcacaatatctaatgtatagtagcctttcaataaagtatttattgcatgaatatactatatgataaagtagacatattgatagttatctctactatttcactcacaaataaagtgataattaaaaatctctaccgtgaaagtctaatttcttcatatcacaaacccacaaattactacatggataatctcacaaagtacaagaacacaaactatcacttcaacctagggtagtggttcttacacttgttaaattaagattcatctaaagctgcctcctcacatatttttaattcagcctaaaggtttctccattcatggtgaactgtaacctaactggatgtgtaaacagactacagcttactcttgtgccactcactgagttttggcaattaaaggcaatcaatcgttcaaaccagattcaaataaggcaaacgcagagctgtaaccaatcctgctgtttctgtacctcgcttccattttgtgtacatcactatccttcttctgtccataaatcttcaatcatccagtagtgctgcagcctctctgaacctattatgattcaggggctgcctgatccatgaatcattctttgcctactaaactctgttcaatttaatttctttaaggtttttcttttaacatcctggagtgtactatgaggatcaagtgataaacatttcaaatataaattattggattctagttctccaaaatcccattgtgttttcaaaaagttccccaaacgatttattacggttaataactcttgaaaatgaacaatccatacccaatttgacaataaagataacggtgaatgaagaatcaattaatcaaaaaatgtagaagtcataacatttataatagaatccaatcaagtaaaacttaaaaggaatatagcaatagacaggatataaagtataattattttagcatctaggttaaaggaaatacacaaaacaattttctttcgtgtggacgccagatcctataaagtaatggcaactgtatgaatttaaatgtctctccccatcctccaaagacacatacagattgataaagagaccaaataaaaatgcccatcatccatgactacatcataaaaaggagaaagggaatacaaatccctggattaacatgtaggtggccaaataaagataccaaatcagcagaattagatcctgagccagagtggtagcatggggaaaaaaggaagtacctcagggtcctagtagtggtggaactaaatatcatcaaatactgacctgtcaaagaaaagtggcctaccttaagtgggccacacaaaaaaacttaatggctcagagtgccagagatgggcacaaaacaaggggcttggaaactatgaagaaccagaaaggcagttctaggaaggaatcacttctgaggtagagagaagcacctttgaaggaaggttgttcatgataaagggagataaaaaagcagctgaagataagggccctgcagaaacaagacagaatcaaagaatcaaaagaagacaagccatggccaggagctgtggctcttgcctgtaatcccagcattttgggaggccaaggcaggcagatcacctgcagtcaggagttcaagaccagcctggccaacatggtgaaaccccgtctctactaaaaatacaaaaattggctgggcttagtggcaggtgactataatcccagctattcaggaggctgaggcaggagaacctcttgaacccaagaggtggaggttgcagtgagctgagatcatgccactgcactccagcctgggtgacaagaatgaaactctgtctcaaaaaaaaaaaaaaaaaaaagaataaagaagacaagccaggctgacaaccacaaaaggcaccatttgttaaagaagttaaacttcagtgtagcagaggaggagggctgtccagaactaagaaataaagtaagccacccactaccacttcccacacaatcactggctattacttgttcagaaaaatctaacagataatcatgaacagaaaaaaagaatccaatatccacaaaaacttactatataaaatagaagaccaaaatcaaaacctgccagcagaaggaaacacttttttaaaaagctaaaatacaggaaaacagtaatacaggcttccttttgattcccatatctccccactctcatacaccagggtttttgtgcaacccacttaaaataggacgctctcctacatgtcaatacttaataatatttttgttccaccaccactaggacaacaggtattcaaatataacttttaaataacttcaggcataaaaatactacaaatcaaaataaagacaaaaatacaaagatgttaaataggaggtgactagattcaggaaaaaaaaacatggaagagtaacaaaaatcatccaagaaatgaagactaaattaagagttgtacaagagagaggctggacatggtggctcatgcctgtaaccgaggtgggcggatcacaaggtcaggagatcgagaccatcctggctaacacagtgaaaccccatctctactaaaaatacaaaaaaattagatgggcgtggtggtggcagcctgtagtcccagctactcgggaggctgaggcaggagaatggcatgaaccctggaggcggagcttgcagtgagccaagatcacgccactgcactccagcctggacaacagagtgagattcccgtctcaaaaaacagaaaaaaaaaaaaaaaaagagttgtccaagagagaaaagataactatagtaacagcaagagataaagataggacctgaagccaaaaaccaggaaataaaactgacataaaaacgtgtttaaaaaggatccaagagaaatggataaagaaaatgagaaacaagaatacaataaatgtataattggattccctgaaaaaaataaaataaatgcaactaaatattttaaattattaagaaaatattcttaaataaaataatacctgaatcatattaaatactctcactctttaccttggaaaactgacctaagaccatcgactgaaacataaacagatggccctccatattcatggcttctacatctacatattcaaccaaccaaactgaaaatattcaaagtaataattagaaaacaagaaaacagtacagtataacaactatttccatatcatttatattgtattaggtactataagtaatatagagattatttaatgattcataggttatgtacaaatactgcactactttatctaaggaacatcagcatttgctgattttggtatctgtgggaaggaaggaggatgttctggaatgaatcaactcttgatactgagagatgactgtacaatatattgaataaaatccgatgtgatatgccgaatatctttcagagtataatataaaagtccaaatattaaactttacgaatattttttaaaaattctctggaccctcagtcaaaaagattagacatttataactttatttatttatatatttatgaaaaatgaaaagtatgtatcacacttctcaactgtaacatacatcatataaaacattgtatttaaggaactcaggtaaagaaaatgcaaatcaaatattttacatacaatctagatttcctccaagaatcaagaccataagaaaccatttgaaacatgcaagaattcagaaaatactgtatcacaaggtccattcagtagactctattagagcatgaacattttatcttagttaaaagataatcaagagggaaaaaaaagataatcaaggaaccttcagtcaagagactgatgcttcctgattaagtattataacatctgcaatttactttcaaatagttccaataaggcaaaatcacaaaatttaaaaggcagcagcaataagttactgttgtactattctttttctacttgaatattttcatcataaaaattgtaaaaaaaaaaactggtttctttaacaagatagcataaacctaattgataattatcttatattttgattttgggaaaccaaatactattgattagtccagttaaatggcagtttctgattactgtatagtttaaatacatgctggaaaaaaatgctttttaaataatgttaattctgagaaaaaaaaacaatcatgctgagtttttgtggaaagacactgcaaaaaacttagtggttatttcggactagctaaatgaaatcaccatggaatttaaaataatacaagctattagatagaagctataaatgtattttagaaagaagagatggctattttttaagaaaaatgtgaaaattattttgtgtagattaaaaaacatcaagctgagaaaagtttcaccatctcaacagttatttttccaccttatatagataaaagcatggtagttttgagaagacaaaaaatctgagagtacataagtaactagaaaacaatatcagagatccttcaaagaaataatttcttgtgtcacacctggggttatgtcatattctttcaacaattatttactaaacatctaccatgtgccaggtactttgagagacgtttatgacaagctgtgagaaaaagaactgtaaacacctgaaaataacacctgatggaaactctacataaagtaataaataggccataaatggtaaatggttgcataaatagataaggcttttaattttatattttcaatccattcaatcaatatataactatttaaaggaaaatgaacaaaaacataatataatgaaaataatatattgtggagtttataacattaatagattaaaggaagaaactatataatcctctcaaaagataaagaaaaattcaggccaggcatggtggctcacgcctgtaatcccagaactttgggaggccgaggtgggcagatcacaaggtcaggagatcaagaccatcctggctaacatggtgaaaccccgtctctaccaaaaatacaaaaaaattagtcgggtgtggtggcgggcacctgtagtcctagctactcgggaggctgaggcaggagaatggcatgaacctgggaggcagagcttgcactgagccgagataacccactgcactccagcctgggtaacagagcgagactccatctcaaaaaaaaaaaaaaaagaattaaaaaattccacaaccattcatgatttttaaaaatatcctgacaaaatagagacatttttaatttgataaatggaatctaccaaaaaaactataagtaagaaaaaactacaagtatgaaaaactagccaggtgtggtggctcacgcctgtaatcccagcactttgggaggctgagctgggcagatcacctgaggtcagcagttcgagaccagactggctaacatggtgaaaccctgtttctcctaaaaatacaaaaaattagccaggcatggtggcgtacgcctgtaatcccagctactcggaaggctgaggcaggagaactgcttgaacccaggaggtgaaggttgcagtgggccgagatagtgccattgcactgagtgaataagagcgaaattccatctcaaaaaaaaaaaacaaaccatgaaaaactgaaagcattccctttaagattgggaatgatacaatgagtaccacccactatgaacatgctcctattcaacactgtagtggaatcctaaacagcatttttttaaaaaagataagaaaaggaaaaaggaggaggatagaaagaaagaagagggtacaagattagaaagtaaaaactagaacacctcatcatttgcagatacctacttacatagaactctataaatgaataaataaacaagtaaataatagaactaataagagtttggcaaagttgccagatgccaaaccaacatataaaagtcaactgcgatcaaagaggcagagcaaaatgttcaaatagaagcctttagcaattttccccgcagcatgaacatcaaattgaacaactattcacataaaaaagcaccttcataagaagaaaaaatcaggtgagtgatcacagtacctggttttagcatattaaggaatgagatgccaaagaaggtaggaaagacagtcttaaatcacctgcatcacccttctcctatcccccagcagtggctacatggcatgaagagagaatctgtgtatttggggaaggaagagcacagtgattgtgggattttgcattgaaactcagtgctgccctgtcacagcagaaagaaacagcaggcagaattcagcttgcacccacagaggaacatttagaccaaccctagccagaggcaaatcattcatcccagcagtcggaaccttagttctagcgaactccaccaccaccatgggctaaagtgcactggagtcctaaataaacttgaaaggcagtctaggtcacaaggactgcaagtcctaggcaatctctgatgctgtgctgagctcaaagccagtgggcttgggggtgcatgtgacatagtgagacaccagccagggtagccaagagagtgctggtgtcactcccaggcaacacagtttgcagctctgagagagactccttcactctgcctgaagagaggagagggatgagtaaaaagaattttgtcttgcaacttggataccagctcagccacagtagactatggcaccaggcagagtcccaaggcccccagtccagggcctagctcccaaacatttctaaacacacactgggtcagaggggaaccgactaccttgaaagaaaggacccactcctggcagaattcatcatctgctgactaaagagcccttggtctctgaatgctcagcagtgacagctaggcagtacttgcgtgggcctggggtaagacttagtgtcatgctagcttcaagaatgatcccgcacattcccagatgtggtgtctaggggaagaaatcccctcagcttgaggaagggagagggaagacaaaagggaacattgtctttcacctttggataccaatttggccatagtagggaagagcaccaagcaggctcctggggtcaccaattccaggccttgggtcctggtaggcatttctggcagcagacttctcagtggaaatgtaacaggccaaaagagaggggcatgacatatttaaagtgctgaggaagaaatgcttttatcctggaatagtatacccagcaaaaataaccttgagggatttgatcaacaccagacctatcctacaagaaatgctaaaggaatttctttgatccgaaaggaaaggacattaatgtgcaataatgaatcatctaaaggtataaaggtcactggttatagtaagtattatacttagtaaagtaagtatattactattataacactgtaattgtggtgtataaactactcatatctgaagtagaaacactaaaagatgaaccactcaaaaataataactgtaacaatttttcaagacatagtgtaataagatagaaacaacaaaaagttaaaaagtggggggatgaagctgaagtgtagagtttttattagttttctctttgcttgtttatgcaatcagtgttaaatgatcagcagtttaatataatgcgttaaattacatgcacatttcatgctaacctcaaaccaaaaaacctacaacaaatgcacaaaaaataaaaaccaagaaattaaaacataccacgtgagtaaatggctttcactaaaaggaagacaggaaggaaggaaaaaggaagagaagaccacaaaacaaccggaaaacaactaataaaatggcaggagtaagtccttacttatcaataataacattcaatttaaatgaactaaactctccaatcaaaagacatacagtagcttaatgaaaacacacctgggccaggcacagtggctcatgcctgtaatcccagcactttgggaggccacggtgggcagattgcttgagctcagcagttcaagaccagcttgggtaacattgtaaaaccccgtcttcacaaaaattccaaaaattagctgggcattgtagcgtgcacctgtagtctcagctacttgggaggctgaggtgggaggatggtttgaatccaggagtcagaggttgcagtagccaagatcatgccactgcactccagcctgggtaacagagccagaccccatctcaaaaaaatgagcctaataactatttacagaacatttcatccaaaggatgtaaacattcttctcatccacatatggattatccacaaggacagactgtatgttaggccacaaaataagtctttaaaaacttttttgaatttaaattgcatcaagttttattacctctgaccacgaggtaataaaactagaaatcaataacaggaagaattttgaaaactatacaaacacatggaaattaaatatgctcctgaatgacccatgggtcaataaagaaataaagaaggaaataaagaaggaaaattttcttgaaacaaataaaaatgaaaatacaacataccaaaatctatgggatacagtaaaagcagtagtaagaggaaagtttatagcaagaattatcaatatgaaaaaggtagaaaaacttcaaataaacaacctaatgatacatcttaaagaattagaaaagctagagcaaaccaaccccaaaattagtagaacagaaataataaagatcagagcagaaataaatgaaatgaaaatttaaaaaacacacaaaaaatcaacaaaacaaaaagtttcttcaagagatcaaatcaacaagccttcaaccagatgaagtaggaaaaaaagagagaagattcaaataaataaaatcagagatgaaaaagagacattacaactgatatggcagaaatcaaaaaatcattagacgctactatgagcaactatatgctaataaatttgaaaactgaaaagaaatgtataaattcctagacacatacaacctaccaagagtgaataaggaagaaatctaaaacctgaccagaacaaaaacaagtaatgagattgaagctgtaataaaaacatctcccaacaaagaaaagcctaggacccaatggcttcactgctgaattttatcgaaaatttaaaaaagaactaatatcaatcctactcaaactattccaaaaaacagaggaggaaggaatatttcctaactcattctcaaggctagtattaccctgataccaaaaccagacaaagacacaccaaaaaaagaaaactacaggccaatatgactgatgaacattgatgcaaaaatcttcaacaaaatactagtatactgaattcaacaacacataaaaaaaaatcattcatcatgaccaagtaggatttatccccaggatgtaaggatggttcaatataggcaaatcaatccatgtgataaatcataacaacacaatgaagggcaaaaactgtatgaacatttcaattgatgctgaaaaagcatttaataaaattcagcgtcccttcatgataaaaaccttgaaaattctgggaaagaagaaacatacttcagtacaacaaaagtcatatacaacagacccacagctcatatctatattgaacaggaaaaactgaaagcctttcctataagatctggaatatgacaagatgcccactttcattactgttattcaacatagtaccgaaagtcctagctagagcaatcagacaagaggaagaaatacagggcatgcaaattggaaaggaagaagtcaaattatgcttgtctgcagattatataatcttatatcttaaaaaaacttaaagactacaacaaaaaactataagaactgacaaacaaattcagtaaagttgcagaacacaagatcaacatacaaaaattaatagcatttctatatgccaactgcaaacaacctgaaaaagaaatcaacaaattaattccatttacaatagatacaaataaaataaaacacctagaaattaacttaaataaaagagtgaaagatcagtacaacaaaaactataaaacactaatgcaagaatttgaagaagacacaaaaaaatgaaaagatattccatgtgcatggattggaagaatcaaaattgttaaaatgtccatactacccaaagcaatctacagagtcaatgcaattactgtaaaaataccaacaacattcttcacaaaaatagaaaaaaataatactaacatttatatggaaccaaaaaaagactgagaatagccaaagctatcctgagcaaaaagaataaaactggagtaatcacatcacctgacttcaaactatagtacaaagctacagtaaccaaaacagcatggtagtggcataaaaacagacacacacaccaatggagtaggatagagaacccagaagtcaatccatatatttacagtgaacttatttttgacaaagatcacaagaatacatatgctggggaaaggatactctcctcaataaatgatgctgggaaagctggatatccacatgcaaaacaatgaaattagagccctatcccttgtcatacataaaaatcaaataaaaatgtaggaaaaacttaaatctaagacctcaaactaggaaactactaaaagaaaacactggggaaactctccaggacattggagtgggcaaagatttcttcagcaattaccccacaagcacaggcaaccaaagcaaaaataaacaaatgggatcttgtcatgtcaaaaagcttctgcacaaccaaggaaacaatcacaaaaaatgaagagacaacccacagaatgggagaaaatatttgcaaaggagctcaaacaactctataggaaaaaaaccaataatccgacttgaaaatgggcaaaagatctgaatagacatgtcttaaaagaagacatataaatgtcaaacagacatatgacaagatgtttaacattactgatcatcagataaatgcaagtcaaaactacaatgagatatcatctcaccccagttaaaatggcttctatccaaaagacaggcaataataaatgctaacaaggatgtggagaaaatgaaacctttgtacagtgttaataggaatgcaaattagtacagccactatggaaaacagggtagagattcctcaaaaaattaaaaatagaattaacatatgatccagcaatcccactgctaggtatatacccaaaagaaaggaaattagtgtatcaaagagatatctgcatgcccatctttgttgtagcactgttcacaatagtgaagatctggaagcacgctaagtatccatcaacagatgaatggaaaaagaaaatgtgttacttacacgtaatgcagtactattcagccataaaaaagaatgagatcctgtcatttgcaaaaacctggatggaactggagatcattaagttctgcaaaataagccaggaacagaaagacaaacttgacatgttctcaattatttgtgggagttaaaaattaaaacagttgaactctgcagatcgacagtaggatgatggttcacagaggttgggaaggatagagggggttggggaaagtggggatggttaatgggtacaaaaatatcgttagagagaatgaataagacctagtatttgatagcacaatagggtgatacagtcaagaataatttattgaacatttttaaataactataagagtgtaattggattgtttgtaacacaaatgaaggatcgatgtttgagatgacagatacccatttatcctgatgtcattattatgtatcatatgcctgttatcaaaatatctcatttacctcataaatatacatacctactatgctcccatacaaatttaaattttttttacatttaacatgtaccctaaaacttaaagtataataataaaaaaaaaatcaactgcatttctgaaatgagtaaaaatcatctaggagaagagtttacaaagatataatttctaatatactgcataattcctagataaactgacaaaatgataccctagacctttatagagcaaataagcttcatcaaaagattagggctaaagactgaaaaaaaaatagagagtagaatccattttggacagtctcgatgttgcaaaaaatgtcaattcttaagttgatctagcaattaaatgtgatccaaaccagaatttcaacagggtttttgtaaaacttataatgaccttacaaaatgtatataaacaaaaacagggcaaaagtagtcaagacatgcctgatgaaaaaaatcaaggtggggcaattggcaatttataaagatataataaaaccatccgggcatgttggctcacgcctgtaatcccagcactttgggaggctgaggcgagcagatcatgaggtcaggagatcgtgaccatcctggctaacacggtaaaaccccatctctactaaaaatacaaaaaatttgcctggtgtggtggcagacacctgtagtcccatctactcaggaggctgaggcaggagaatggtgtgaacccaggaggcggagcttgcagtgagccaagattgtgccactgcactccagcctgggtgacgagcaagactccgtctcaaaacaaaacaaaaaaacaaaaagttagccaggcgtggttgtacacatctgtactcccagctactcgggaggctaaggcaggagaatcacttgaacctgggaggcggaggatgcagtgagcagagattgcgccactgcattccagcctggcaatgaaatgagactctagctcaaaaaagaaaaaaaaaagaaaaaaaaagaaaagaaaagatacaataaaactatagtaatgtagacaaaccaattgaaccaactggaaattggcagaaagaaactcaagtatacttatttgataatgtgatttgtgaaaggtctagcattgccaatttttgagaaaagaagggaatgttcaataaatagaagaatataaaatcagatcacttcctcacaccatatataataaattcccaatggattcgatcttatattaaaagcagaactacaaaaactttcagaagacaatttagaagaatgatgttatggcctcaatctagaaaagatttgccaaacaagaaatgaaaaaaaaaaaagcataaatacaaaaaatcaactcaagatggattaaagacttaaatgtaaaacccaaaactataaaaaccctggaagagaacctaggcaatacatcctggacatagtcctagcaaagattttatgacaaagacaccaaaagcaattgcaacaaaagcaaaaattgacaagtgggatctagttaaacttaagagcttctgcacatctgcacagcaaaagaaactatcaagagagtaaacagacaacctacagaatgggagaaaatgtttgcatctgactagggtctaatatcccgcatcaataaggaacttaaacaaatttacaagataaaaacaagcccattaaaaagtgagcaaaggacatgaacagacacttctcaaaagaagacatacacgtggccaacaagcatacggaaaaaaaagctcaatatcactgatcattagagaaatgcaaatcagaaccacaatgagataaaatctcacaccagtcagaatggctactataaacaaaatcaaaaaataacagatgctggcaaggttgtggagaagagaacacttatacgctgttgataggaatgcaaattagttcaaccattgtggaaagcagtatggccattgctcaaacagctaaaagcagaattaccatttgacccagcaaccccattactgcatatatacccagaggaatataaatcattctacagtagagacacacgcgaatgttcattgcagtactattcacaatagcaaagacatcgaatcaacctaaatgcccaccaatgacggattggataaagaaaatactgtacatatacccacggaatactatgcagtgataaaaaaggatgagatcatttcttttgcaagaacatgaatggagctagaggctattacacttagcaaactattaaaaacacaggaacagaaaaccaaatattgtatgttctcacttataagtgagagctaaatgacaagaacataagaacactgagaaagaaacaacggacactggagtctacttgagaggggagggtgggaggagggagaagagagaaaagggaactattgggtactgggcataatacctgggtgatgacatgtgtttacctatgtagcaaaccttcacaggtacccccaaacctaaaataaatgttttaaaaaagcatcagtaagagagaaattaataaacttgaccattttaagaacttctccaaaaaatacatcatcaagaaaatgataaaaacaagtcataaactgagagatgtttgcacaaatgattagtctccaaaatgtgtaaacaaggcctttaaaaatcaatgaaaaggccgggtgcggtggctcacacctgtaatcccagcactttgggaggctgaggcgggcagatcacctgaggtcaggagcttgagaccagcctggccaacatggtaaaaccccatctctaccgaaaatacaaaaattagccaggcatggtggcaggcacctgtagtcccagctactcgggaggctgaggcaggagaatcacttgaactcgggaggcggaggttgcagtgagccaagatggggccatcgcactccagcctgggggatgagagtgagactttgtctcaaaaaaataaaaaaattaaaaaaacaatgaaaaaaagatgtcaatacacttgagaaaattgaggaaaaaaacttggggcacatttcactgatgaggaattatgaatggctcataaacatataaaatatggtcaatatacttagaaatataaaaaatataaagtaatatcacaatgcggtgatattttacaattttatagattggcataaattaaaaatttacaataaaaatgttcaagatgtgaaacactactagtgggtacatgaattggtacttttactcagggaaacaattattaagataataatacaatctacctcaacatggtaccagagaaatgcgcatattcttcagtaaataacacagtgccagccaggcatggtggctcacgcctgtaatctcagcactttgggaggccgaggcaggtggatcactcgaggtcaggcgttcgagaccagcaaggccaacatggcaaaaccctgtctctactaaaaatataaaaaaatcagcagagcatggtggtgcacacctgtaatcctagctacttcagaggctgaggcaggagaatcgcttgaacccgagaagcggaggtttcagtgagccaagatcatgtcattgcactccagcctgggtgccagagtgaaaccctgtctcataatcccagctactcaggaggctgaggcaggagaatcacttgaacctgggaggtagacgttgcagtgagctgagatcacaccattgcactccagcctgggtaacaagagcgaaactccgtctcaaaaaaaagtaaataaataaaataaaataaaaataagtagcccagtgccatatacacactgcaacttgaaaaatagaggcagcaaatgtccagcaggcagcaaagtacatgcaattaaatatgtaccagctgaaggtataaatatgcatcgtcatatatacatatacatatgtatacatgtatgtgtatatatacatatattaggtaataatttatttttggaatgttgcagggttttgtataaagcagcataggaagtaagttcttcaaagatacatgcaattctgcaaatatacaaaacccaactcatgaagcagaatcaaaatataaaggaaaaaataaagaggaaacaggaatttccaaagatgctcaagcactaattaagtttaaaatttaaaaccaaaagccaagaaaaccatctgtgatttatttttattcagctctacatttacaagcagggtacaaaatattggttcagctaattacaatgcagcatttcaactatgcagaagtaactcctatttcaacctcttcatctttaaaagccattaaataaagaagttaaagactcattctagcatcataaatttcctttctcaagttgacaaataaatagaaaatgtctattctaattttttaaagcaacaatgaacactgtaaacaacagtgaattatgttgttattcatttacaatacactgagtttgtctcataaccaattttaatatgcaatgggaattattcatggtaaagcatgttcttgagtctatttgggggaaataagcaatctattttctgattttgtaacagcagccagatgtgctttgaagttcaatgttcccactttgtaatccacaagtaacacggaacttgaagcaatctgtaaacagtcttaacattttttatgctcttttagaaaagttcttcttctctcatactacctcaaaaaaagaataccacaataaatgtccaaaatggaaaataaaaaagtcttaaatgaaacactgaagtcgaagaaaatattgtatagaaagcaaagctgaaaataattaagtttcaatggcacgaataaataacatgtttgcacatttcttgcttaacaggcaaatagaatcgcaataataaaatatgtaataacttaggctagacatgaaaacagacatctgaatactttttaatgaaaactggcttttgactttttattttgtttattttttttagcagatttctttgttgattgtcagggttttctgtccacttgttttttaaaattacttggcatttggtcaaactgacataagcaaagaacctcttataaactaatggttatcaaatagagaagttttacatttccagaaaaattaaaaggcactttatctgatatactatcttagcaagaaggacattgtcaagcaatatattaccagtaacacaactaaaataaatgtttttaaatcatagcatcagtcagaagtgccaaaactctctccatagaacaaaataaattcactcttcaacaccaaattgaatatgctccaaaattatgcttttaagtaaatattttagaactttaaaaccatttttccacagaaaatttacaatactatattccaaaaggactctcatgcagaatagagaaaaagctcttatataggaataggaaaagggcagacaacaggaaaactgacaaagctttcagtaaacactttgagaggctatccaaattgacaataaacatattaaaatgcacctaactgtattagtcatcaggaaaacatatattaaaaccacacaatactatgtcactaactactctcaagaatggctttttttaattaaaaaaaaaaattgcctggccaggcgcagtggctcatgcctgtcatcccaacactttaggaggccgaggcagatggatcacctgaggtcaggagtttgagaccagcctggccaacatggtgaaaccctgtctctactaaaaatataaaaattagccaggcatggtggcggacacctgtaatcctagctactcaggaggctgaagcaggagaatcacttaaacctgggaggcagaggttgcagtgagccaagatcatgccactgcactccagcctgggtgacagagactgtctcaaacaaacaaaaaaaaaaccctgacaatactaggtattggagaacaggcagagtaatgggctctagcacacagtgctgctgagaaggtagattggcacagccactttggaaaactggcaatatctatcatatcagttagctttttgctgcataacagatcatcccaaaacttcatggcttgaaactacaaccattttatttagcacccaattctgtgagtcagcaacttgggcagctcatctactgggacagtgcattcttgaaatcgacccaagagtcccatagacagttctttcggataaacatagaaatgtgctcttctggtcttaaagtttgaaacttgcatttgttttatctgagttccctcctcaggcatctcaataaaatatcaaagaactgaaactgaccagatcaccacatccagacaatgcaatgctggacccctcattcaccatgattgctcctttatttctccctagttcctgttttcttacacattgttacagttcttccctgctatgtaaacctctaattttagtcattcagagagattaatctgagattgatctcccatctccttggctgcagcacccaattaaagccttcttccttggcaataattgttgtctcagtgattggctttctgtgcagcaaacagcagggcctagactgaacccctggtgtttcagtaacaatctcagctggacttccttgtctgttggctatgccagtgtgatagctgccctcaataagccccgaaatgaaggttaaagcaggtctcaatcagccccaaaatgaaggccacactgagtacaatggccaggtttccacatttcttacaggaagaacagaggaagaaaattttgacccagcagagggttagaaaaaatttgacccagctacaagacaagggaagggtaagtaatgaaaaagtatttaccaacttttccttgaaatttgtaacgttccttacacactgatgcattttatataccagcagatacagtgcttacctataattgtgagagctctgtatctaccattatgatctcttttcaacaattaacatttttttttgtcctcttgtttctagatcacattgaagacaccataaagttttccgttttattgttctttgcaaagatccagcttctgtttcattgattagttctaatgctttgggggaaattttgattgtttcttgtaggtttttgtttatattttggctttgtttttttaattgattaaattaaataagggatctttgatcctcaatatcactttgggcacatcacagaatgttttgtcaaattttaccatgatttattttagtctgcacttggtttttattactgtttttacacaaagctattcaggagtgtgtttgtacttcattttaagctttcagatgaaaacacggaaagggaactatctttttgatgttactgtctagctttattcaaatgaactcatttaattagaatttctttatgcctcagttaaatcagttttataactatcccatgactatgtgaaaagtctataaatccatatcccattcttttagttggtctttgttctggaaccatactttttattcacttttagaaactgccataccattttaaaaattatatatgaagcatggtaatttctccaatctccttttttttttttttttttttctgagacggagtctcgctctgttgccaggctgggaaacagtggtgcgatctcggctcactgcaacctccgcctcctgggttcaagcaattctcctgcctcagcctcctgagtaactggaactacaagcacatgtcaccatgcctagctaatttttgtatttttacaaaaatttttacaaaaatacaaaaattagtagagacggggtttcaccatgttggccaggatggtctggatctcttgacctcatgatccactcgcctcaatctcccaaagtgcttggattacaggtgtgagctaccgtacccaggctcaaaatttttttcagttctttcaaaaaggtaactctaggtgaatcatgatttttaaaaggaaacatactacatagaaaaacagaaattattagtcactctgataggcttcagctcttttacccatcgttagctatagctataaatggaatatatccttgcaggtcaggagcacaaataatttctttctttttccttaaaacaataaataaagcacaagaccaaaaaaaaaataaaatgttgctcatggctgactcctcatggaaaacagcagaatatattaactttttgaattttttaaatttaaattccctctatgcctctgtgagctttgacaaaagaatacagtggtataaccagcaaaataccaagaaaacagttctgttggtgaaacactccaggatattggtctctgcaaagattatttgagtaagacctcaaaagcacaagcagccaaagcaaaaatggacagatggggcgacatcaagctaaaaagcttctgcacagcaaaggaaacaatcaacaaagtgaagagacaacccacaaaatgggagatatttgcaaactaagtatctgacatgagattaatgaccaaaatacataaagagttcacacaacttaatagggggaaaatccctcatttttaaatgggtagaagatctcaatagacacttctcagaagaagacatacaaatggccagcaggtatatgaaaaaaatactcaaatcattaatcatcaaagaaatgcaaatcaaaaccataatgagataccatctcacatcagttaaaatggcttatatcaaaatgacaggcaataaaggatgctgacgaggatgtggagaaaggggagcccctagacactggtggtgggaatgtaaattagcacagccactatggagaacagtatggtggtttcttaaaaaattaaaaatagaactaccataagattcatcaatcccaatgctgggtctacatccaaaagaaaggaaatcagtatatggaagagatatctaatagtgctgtagtaaacatgggacagattactgcatttatactaaactcccatgattattgcagcactattcacagtagccaagatatggaatcaatcttattgcccatcaaaggataaatggataaagaaaacatggtatatatacacaattgaatattatttagctataagaatgaaatactgtcatttgcaacaacatgaatagaactggaagacattatgttaaatgaaataaggcaagcacagaaagacaaatatcacatgttctcactcatatgtgctaatgtgctagctataaaaaagaaaatgaactcatggaggtataaaatagaatgatggttaccagaggctgggaggggtagtggggagtgagggttaaatagggactggtaaataggtatgaaaatatagctagatagaaggaataaaatctagtgttcagtagcatggtagggtaactatagttaacaataacttactgtatattttaaaataactgaaaaatgggattgaaatattcctaacacaaagaaatggtaaatgtttgaggtaaatgatatctcaattactctgatttgattataacacatggtatgcttgtatcaaaatatcacatccccataaatatgaactaatatgtatccataattaaaaattttaaaataacaaaatagttccatcaaacaaaaaaaaatccctagtgcttattcacaatagcaaagacatggaatcaacccaaatgcccatcaatgatagactggataaagaaaatgtggtacatatacaccaaggaatactatgcagccataaaaagaaaaaagattatgtctttgcagggacatggatgaagctggaagccatgatcctcagcaaactaatgcaggaacagaaaaccaaccaccacacgttctcatttataagtgggagctgaacagtgagaacacatggacacagggaagggaacaacacacactggggcctgtcaggggaggctagagggttgtggggagagcattagaaaaaagagctaatgcacgctgggcttaagtgatgggttaataggtgcagcaaaccatcatggcacacgtatataacaaacttgcacatcctgcacatgtaccccagaacttaaaaaataataaaataaaaatctctagtgctatttatacccttgtagccaaattctagcccaacacctggaaactactaatctgttctccattcttatagttttaccatttccacaataccatataaatgcaatttaaaaaacagcctttttagtctggcttcttccattcaatataatatatttgaaattcatccactttattgtgtgatttgataattgagtccttttcattactaaaaagtattctattgtatagatgtacatataatttgtttatccagtctccagttgaggggcatttaggactatttgcagttttgaacaattaccagaaaagagggagagagagaactgttaaaaatacttgcatataaagtttttgtgtgaacacagactttcatcacacttgagtaaatacttaggagtgagattggtgggtcatgtgataaatgtgttttaattttttttaagtgccaactgttttccaagtaatattttgcagcaagaggtgagggttccagttgctcctcatcctcaccagcattttgtattgtcaggtctttgtttgttttcaccattataataggtgtgtagtggtatctcatcatagcatcttttgtcccatcttttaattaggttgttttcttattgttgaggtttcagaatctttatatattctggataaaggtatttgccagatatgtgaatatctccctaagatgaaactggcctcacaacacaaattggaaagtgttccctcttccggtggagatggtatagaattggtattatttctcccttaattgtttaattaaatttgtcagtgaaaccatgcaggcctgaaattttctttgttgggaggtttttgtttttgtttttgagatggagtctcactccatcgcccaggctggagtgcagtggcatgatctcagctcactgcaacctccacctcctgggttcaagcaattctcctgcttcggcctcccatgtagctaggactacaggcacatgccaccacacccagctaatttttgtatttttagtagagacgaggttttaccatgttggccaggctggtctcgaactcctggcctcaggtcatcagcccaccttggcctcccaaagtgctaggattataggtgtgagccactgcgcccagcctgttgggaggttttaaaatataaattatatttatttaatagctataggactatgcaggttatctatttcatcttaagtgaatttttggtagtttgtgttgctcaaggactttttccctttcatctacattgtcaaatgtatgcccatagagttgcttgcagtaatctcttattatactttgagtatctatagtgtctgtaatgatatcttctctttcattcttgatattagcaaatctattcttttcattctttgtcagtctggctaaaagttcattgattccattcatcacttaaaaatccagcttttggtttcactgattttcattattgcttgtgttcaatttcattgatttctactttaatctttattatttccttcatctgcttactttgggtttaacttgttctttcgccagtttctttagatgggggtttagattcataatttagaactttcttttctctcttggtgctttcaagattttctctttgttggccgggtgcagtggctcatgcctgtaatcccagcactttgggaggccgaggcgggcggatcgcctgaggttgggagttcgagaccagtctgaccaacatggagaaaccccgtctctactaaaaatacaaaaagttaggcgtggtggcacatgcctgtaatcccagctacttgggaggctgaggcaggagaatcgcttgaacctgggaggcagaagttgcggtaagctgagatcgtgccattgcactctagcctgggcaacatgagcgacacttcgtctcaaaaaaaaaaaaaagatttctctttgtttctcagcaattttagtactgtggctaagtgtgactctttgtatttaaacttgaagtgcattgagctttttggatgcgcaaattgatgtttctcatcaaactagaaattttgcagccaatcattcttcaaacgtattttctgctcctttgtctcctcttgttctggtacccgcattacacatatgttggtgcacttatggtattccacatttccgtgaggcaatgttcatttttctgcattcttttttcactctcttctttggcctgcataatctctatcaatctatcttcaagttcactgaatcttctgccagttcaaatctattgctgagcccctatggtgaatttttcacttcggttatacggtttaacactataatttccatctgttttttttttttgctttttgtttttagagatgggggtctcactatgttgcccaggctggagtacagtggctatgcctcctgaggagctggaactataggtgcatgccactgtgcccagctctggttctttttcataatttaaatctctttatgatattctgtatttgatgtgatatggtcatcacagctttctgttttttgctcttgtttttgtttttttcagacagagtctcgctctgtcgcccaggctggagtgcaatggtgcgatctcggctctctgcaacctccacttcccaggttcaagtgatcctcctgccgcagcttcccaagtagctgggactacaggtgtgcaccaccatgcccaaataattttttgtatttttagtagagatggggtttcactatgttagccaggatggtcttgatctcttgacctcgtgatccgcccacctcagcctcccaaagtgctgggattataggcatgagccactgcgcctggcccatcacagctttctttacttctttaaacatcgtttcctttagttctttgaacacatttataatggctattttgaagtctttgtttgttaaatctggtctcacaggccatttctgttgcataatttttctctgtataagggccatactttcctgtttctttgcatgtcttataattttttttcttgaaaattggacattttaggtaatacaatgtagcaactttggacactgattcccctctccatgagtaattttagttgttttcatttgtttatttgattagtggcttggctagactatttcataaagtatatttctcccacagggtgaagactttggaatcacccctcagtgtatgcagccttgggcatgcatacagtcacctgtgatgacagtggatttagcagggctcctctgttttttccccttatctttttgttgaactctatatctaatttgatatgacacccagctattatgtctactaattgctggctgtttgttctattattttcaacaacaccctgggtcataaattgctccataggctgatccaattaaattcaggcaggggtagatgctgaggtagtctctgaggattgttctgaccccaggaggactcttcttagctgtctctgtccctggttctctctggtgaatgtactagcctgtggtttagcttactgctgttaattagtaggaactaccagtctcctctttaaaaatctccattgttttctacagcatccttaggtttgaacttcccaacactgtttccattagtccatttctttgaggagagcttctgatctcactggtcttcagactgcctctccccctgtacaaaaatctatgagctactacactgggcactgtgcagagggagtagctttcttgttcccggcttgcatctcttggagtgaaatctctatcctatgaacaagtcgaggtaaggacaatgaaggccacagtattcttgacctactgtgtctggggtagagcttctgccctatcagtcttggctgagtggaggaaaagagccctttcccccaaccactaagctgcactcaccaggaatttagccacctccacttagacttcaaagggataagaaatgctggcagcatgcccctcccaatacaatactgtatcccttgattgggagctcaggggagagaaacttcatcttctttgccacacccactgggaatggaatttctgtgaagctgagctggagaaggaacaggggaaaagtgaaagcgagtcatggttgaagtgccaaaaactcttgctgttcttaccaagctgtagttgattttcttgaataaatgtcttcatttgctctatgcctttaggacaatttccagatttaattaccaattagcaattatgcttgttttgctagggagcacatctgtggagctcctcatgctaccattctagaaatagaaaccccctcttcttttctaaaataagtatttcatgctgtaaatttcccaatgaaacctacttgggctacatcccacacattttgatatgttgtgttgtcattttaaaatattttctcatttcccttgagattttttcttttacccctggattatttagaagtgtgttgtttaatttctaaatatttgtggatttcccaaataatttgttaccaatctctagtttaattctctatgatctgaaaaattattatcttaatcattataattatattgtaaggttctgaaaaatggcgatgcttgttcatttgtctcagtggacagtcaactgcattcagatcagtctgcgaattccatctctcctacggacagtagctctggtgtcagtttcaagtttgaagtctttactatgtcatttgagtctgcctctcacatgtaccactcaaggggtggtctgggactagggcaatagtttacatgacagttcagttctctaagacttctatgaggctatgatttgggggctatgttccacacatgtccaccttggggaaagactggaacttgtatggttcatacacagactaccaatccccttctcccactctttccattcctggatttccctgcatactctctggctctgagagcttcttttccagtcccactggccaaactctgaaggaacctcattgcactattgtacagttccaggtgactaggcatactctcagaggaaagtataatagcaagcgaaaatacatgggaaaaaaaaagtatataaaatgttcctcccatattctttgcatgaagagaggtttcttttatctgttgatccagccaaacagatgggcgctaactgctgcccttataccacaatagcatagtttttccactggggctggtctagaggcagggccaagaaagaaaaaaaaaaatcccctcacattcttccattctcccacttctctggccaaaaagatgggctgctctgtaagtttctgccatccatgcctgctacacaatccctcaatttggcccaccctggagtcaaagctgggagttaaggaagaaaaaaaacacaaacagaaaaccaggaaacttcctgccactatatcagtgattcttcatattccaacttccctctcaatcggcctgttattattgacttttcagagtccccagttggtttgctttttgtattttgtccagaattcttggttgtgggagaacctggctgtaatagatttactcatggccagaagtttacattcacttttaaaagaaataaatgtcaacttctcaaataaaactctgaatatagttacactccccaaaagcaagctttggggaaaatgctataaatactgttacggctttgtttgttttttatgaataataaatatttactatttaaaaaaacacttaaaatgttaagaaaataagtgctgatattttaccatgtggaattatcagctaccattttgagtagatacttccagatatttttaaactctagagaaagacaaagagaatttgtcttatcaaagtattaattttttatgtaaaccactctcataactcttcttcatttgggtaactttgtcctagtctcaaaatctgacactttcactcatttgtggaaaactacagccaaatgagaagcctaaaatatcagaattttcagctcagtttctctcccagaccattgcgtagtatgaaatggacaggagtcaggcatggtggtgtgcaccaccagctactcaagaggctgaggcaagacgatcacttgaacccatgagttcaaggctgcagtgagcactatgatcatgccactgcactttagccttggtgacagagcaagaccctgtctctaaaaaaaagaaaaaataagaaaatgggcaggtttctaacctacatgaaaaaaaaagcatgaaattgcctaaaataaaactagataagacagctgaaattagatgcttacttaatgagaattgtcccaactaatcataccacaaagtaccccattaatgaacacatttcccttctctgtaaccttaagtaaaattacaataaagacccatgaagaagaggaaaagaaaagaaaaaaaagaagagaaaaagaagagaaaggagaaaaaggaaaaaataagaaaagagactacaaatctctgtgtaattagaattgcaaagaaaatattatcaattcaattaccacacaagagtaaggataacataattttcttaggataaaagttggtctttctatgtatggccatttttcttttaaaccatcagtcaataatgaccatgatttttagtgctaaatttaaaagcttcattcaatggaagatttcaattgtgtcagcaagctaatttttcccatccatttctatacctataaggtagataaagggatttaaattcaaagagagacaggatgcttaacttgtttcatgattgtgattttcattgaatgttaatattatatgcctcacttatcaaagaaaattcacaagcacattctagaaaccagaatgaacatacttatgactttttcctactaccttaaaactgtagcactttacaaaggaagctacaaataattcctagtcaacatcaaaaacttccaatattcctgacatagatcttaagatattacattaatcgcaaaataaatagaatctaaaacttgaaaaaccaaataagacataatttttaaagttttttttcaaatgggtacacatagagtgtttcacaatgatccacgagtcactaaagggagaatgttccaaagcctccatccatgcaagcactcaaatgaacttacaaatagcgaatacccacagcacaaacattcagcttgtgacttagagagtcagacacgaaataggtaaaaaatatattgagaaagcaagaaagcgtcataaaaactaaatgttgaaaagtttaaatattaagaaaaaatacaagagaaaaatatcattgctagtttttaataaataaatctctatttgaattatgtattcctagaaaaaatactaacatactcctgggaaaataaagaatacatttgggaatttgatttctgggaaaataaagaatatatttgggaaaaatttgattttttaacaaaagctagaaaattcaaattctacaacatctaaggcatcagaatgaaggtgttgacagtaacatcagtaatataaaaaatgtatccgtagtccagagcacaaaaattaactctggctactaatggatcactcagaggaagaaagaaaacaagccagtcacacattctcagacaaaactaaaatcaaagcaaaatctaagctttctaataaattgaatacttaaattattctatttaaagagatattgctcagcctgattaatgcctatatggtacaaatatataaaaatgcaagacttatattttacactgtaagtgtattctttgaacaataaaaatgtgaaacaaaaccctagacagacctacttttaaagtattacctcacaatatcttaaatgttttattttaattttattataccaaggaaagatttaattctcagaacagttaaacaaccgtgaaaagtactctatgtgctaagtaatgtatatcatgtttcaagtggctaagggcaaaggtgagtttaaaaggatagctccagaattttcttttccactttgatgttgctctctggcaaaaggaatttgtctttctgaaggatttcctgtgctcttctcccacactggtaacaggacttgcctccaatggcaacttcccctgcaccttaaaacatgaaaatgtttttcttttgatttattatcctcctctcatcaattctacttctctccttctctagaaaactcccaaaattaataggaggcccacattactttaatttcctatccatttcccaaccttctaactgtgcccattccatgaaccagacatcctcccttactctgctctccacccagacctcctgactctctgagctctccaaagattagagctgttctagtctccgggcgcagctgcctcctcaaacagtgtgactccaacatatacctccagctcttgactctcaggaagctctaggccttgaactatcccatttaaccttaccagttttcaaactccactatttaaattaaaacctttaaaatggatccgccctcatctgacagtcaattaactgacaaaaggccaacatttccgtttctcagaaccaagcctttaggtgcccttcagttcagcctttcaatcagtcacttagcacattttactctctcaaaagtttttcctttttacctttccctcctcccagcaatcatactaacatggagtccactataaagacctaaaacggccaggcgcggtggcccacacttgtaatcccagcactctgggaggccaaggtgggcagatcacctgagggtcgggagttcgagaccagcctgaccaacatggtgaaacccccgtctctactaaaaatacaaaaattagccaggcatggtggcacgcacctgtaatcccagctacttgggaggctgaggcaggaggattgcttgaacccaggaggcagaggttgcagtgagccacaatagcaccactgcactccagcctgtgcgacacagcaagattctgtctcaaaaaaaaaaaaaaaaaaaagacagaaagaaaaagtataagaaaaaaaaagacctaaaagataatcaagaccttgtctgcatttctactcatatccaatagaactttcataatcccaccaagtcaatttccctaaagcactgctttcattaaagaccattattagtaggaagtttttaagttttttgaaataacaatccctaatgtcagtgaataggtggaaaatggacaactgatatactgctggttgaagaaaatggacaactgatactgctggttgaaattggtatgaaccttctggaagacaatgtaccaaagatgtaatgtaagctaagaaagcaatcaaatatgtataaaaagattcttataaggaattttactgcaaaattacttgtgttaaacaaactgggagcaattcagatgtccaaaaatagcagaacacttaaaaagtttatggaatatccatccgaaagaaaaataaatgctaccattcacagtcatttatatagaattcttataaattcatataaaatgttaaattgcatataagatagcatttataataaattttgttgaatcttataaaaacacacagaaaaaagggaggaaaagatatgttatataacaaaatgttaacacaggtctctgttgatttttattcctctgattttctatatttttcaaattacaaattatttttataataaaacatattctaaaatcattctaagcactttttgttgtttcctcaaagcatttaaacagttagcatttatgtaaagtgaaatgagaaaaaaaaaatgcagggctcaatgttgcctaaaatttaaaagctaaacttctcaatttagcattcaaagctccaatgcaacgcagcctgacacagtgcccacagattccatacataaattccaaacacccaatcacgacagctcacttaccccactacatctttcttcgtgcctatttctgcctccaattcccacctctctacctctccaaatactttcatgaccctcagcctctataaactgttttccgtaagagctgctcatccatggggtccccttgagtgtttttaacccaaatggctgtgttgcttcaagttctcccttccctcccctccacctcgggcgactcacataactcatcttggtattctaccatatactatctttaattattatttattattatttaactattttatgtgcatatctcttatttcacacataacaaagttagcttgttggggacagggactattttatgtttgttcagaatgttatttatttcctatacttaagcccttctcaaggccacacagtaacatatgtctaacatccaacgttcactgaataaaatcaaattagttcagatattatacacatacaatatgattttgacacatctatatatacataaagcaaatacttttttttaccccaagattccaactattaaggcgagcttcaatgtcactatcatccaaagaaacaggagattttttcgaataaacttcctgaaatacaaaagggaaaaaggaagaggagaggaaggaaagatggaagaaataaaaggaaaagatggaagagataaaagaggaaaagatagaagagataaagggaaataaagaggaaggaagtaaaaaaggaaaaaaggaagaaaggaagggatgaaaagaagggaaagagggggaagggagggagaaaaagaagagaaagaagtgggacgggagggagaaaaaaagaacaaaatacatgtcattcagcgcaatgagagttttgtgtgcttgtctggtaatgctgtattgccctcagaggaaaggattaggttacaactgaactagggttctcagttctaagtaatgactgctgagggctatgagctgccttaacaatatattcacacagcaactaaatttcaaaaaaaaaaaaattaaaaattaatccaggctcttctctttaagttcttttacaaaaagttttaattgtggtataccacagtagctttaaagtgtattgtcgggggcaggggcgacgtgaaaagatgaattattctcataaaaattagttaacagggaagttttgtgatgatgtccaagaagctctttgttcttaaattaattctcactcacacactgaacataaagataaataatctttggactcacatcataaaaacacaattatggttgggcacagtggctcacacctgtaatcccagcactttgggaggccgaggcgggcagatcacgaggtcaggagatcaagaccatcctggctaacaggctgaaaccctgtctctactaaaaatacaaaaaaattagccgggcgtggtggtgggcacctgtaatcccagctactcgggacgctgaggcaggagaatggtgtgaacccgggaggtggagcttgcagtgagccaagatcacgccactgcactccagcctgggcgacagagcgagactccgtctcaaaaaaaaaaaaaaaaaacacacacaattatggtgattcttcactttttaaaacataacaattccatgcttttttccctcctgtataatttttgtattacacatttatcagccccagatgaaaactataatgaactagagacaacctaagatctgtacccagaaattgacaatgaccagaaaaccctaaaaactaagaaaggtaagtctgtggaaaagaatggctacctgacagcccagaaagtgtattttaaaattagatttgttgatacagcattctcatgcttttagaaggcttaattgctaacaaatgtacctatttatatctatggtcatttaaattactatgaagtaatttttttaaatgcactaaaatgttcttcatattttactgagtttctacatttcttttcaatacaatactgcattattatttataatactatattaaaattcattatcacttctactagtggtcctctgctttttgtatgtttttctcatgaacaagaatttcttaaataagacaatgtacctgccttgcttattctgagtaaatataatgattgtagtttatcactatttaaaatatgctgccctttatatttttttaattccaaattatcattcgataaaatgcaatgagttatgtatatagtgctatgtgctaaaacagtcatgtgttggccgggggcagtggctcacgcctgtcatcccagcactttgggaggctgaggcgggcggatcacgaggtcaggagatcaagaccatcctgactaacacagtgaaaccccgtctctactaaaaatacaaaaaattagccaggtgtggcggcaggcgcctgtagtcccagctactcgggaggctgaggcaggagaacggcgtgaacccgggaggcggagcttgcagtgagccgagatcatgcaggtgccactgcactccagcctgggcgacagagcaagactccatcacaaaaaaacaaaaacaaaaacagtcatgtgttacacatgctttctcttgtaactaaaagtcatgtaactcaagacagccagagttaggcaataaagactggaataagcaggcacagtgtttctcttttccaagctaactggggctgggtgcagtggctcatgcctgtaatcccaacactttgggaggctgtggcgggtggatcacttgaggtcaggagttcaataccagcctggtcaacatggtgaaaccctgtctctactaaagatacaaaaattagccaggcatggtggtgcatgcctgtagtctcagctacttgggaggctgaggcaggagaatggcttgaacccgggaggcggaggttgcagtgagccaagattgcacaccactgctctccagcctgggcaacagtgagactccatctcaaaaaaaaaaaaaaaaaaaaaaaaaaaaaaaaaaaagctaactggagtgctcattagcaccttgtccaaagcaaatctatgttgaacaaatagatgcaagacagacattcttatttcaaaatatacagtttaccttcattagaaaagcagtgttccctacttcactacaagttaattccagcttcttcttaattttatgatcactgggtatataatcatttccacataaattctgaacaaagggaaaatgttattctttgacacacaggagaaacaacagattgatgaatataacacctcagaatcattgaggaagtagaagggatactacactatataccaaacaccccaccttctttaacatcaggatgttcaccagaatcatccaactttattctgttttgaagcaatcattggtacttcaacaaatgaaattaaaactttgttcagctattttaaaacaacaagcaaaaaccaaacaaaagtaaaatctaatcttacacaaatctttggggtaatattttgtccatcttctctgtgagttggactcaaggagtgtgatctcactcggagcttcccagtgtactgttccctgctaagagaccaaaataatcgcaatcacaatttggagaattcagaggacacagagtattagaatctaggattaccatttctttcccttggaactgagatgatagtttgtattaacaatgatgttccatagccgggcgtggtggcgagtgcctgtaatcccagctacttgggaggctggggcaaggagaatcacttgaacctgggaggcagaggttgcagtgagctgagattgtgccactgcactccagcctgggagacagtgcgagactcatctcaaacaacaacaacaacaacaaaaaacacacaaaaaatgatgttccacatcaaaaaaaaaaaagaaaagaaatacaagtaataacctttttatttatatttcatttcatttaaattataagaagttacataaatgccacagacttgcttatgcaaatgctatttttaagtcagactgtaataaatcacctgtatttaaatcttttctcctcctttcccatttttcccaagtgtaaaaagagagaaaatgaagcatatattctacgggaagaacattgttttaaggtcagcaaacttggttggattcatgttccacatcaacatgaagccttaaaatatataaaataacaaaaccttcatgtagtttaaagtttcaattaatttgaaagcatgtcagaaaccacagatatatcaaaatcttctatttaaaaacacaccatgttaatttaggtaaaatgtgaaatgcagagtaagtaggaaatgagtttaaatggacttcatcaaaaagactcgtctctaatataaatatcatataaaatacattcttaaatggcctcctttagcctggagtctctcttatatgattttattcaaaccacttcaatgcaagtcccatgattatgaacacctattctctgaacaactgcttcaagatatattaaatggaaaataaccattatacaatgaattaaagtcactaacattcaaccacaaaccatattaggatttccttcacaaactgtgacctacacgaagtatttctaaaagacagaatgttaattcaaaagacaatattaaaacaaatgtattttgtaattaaaactcacagaataacattccttagactagttaataagtaatgtaaaatggctgaaaaagctgttttaaagagagctgttttttttaatacccctattcagtagtacaaacatccaaatagttaaaatcaaatgagaaaaatgggcaaagttaatattttgagtataattgtaccagtcaatgtgcatcagctgatacaagcatttaaaactctatgaggagaggtaacctgatatgtcatactaagcagtggcgtattcttaagaatagattaaataatcataaaaagatctatacttaaaaattgaaaaatgcttaaatattaaaattcttctcataaaaaaatactaatttaaaaatgagcctgaaatgtttatctatttattgcacagggttgcatacataaaacgacacaccctcttgtttcacttgtagctgtccttctgtaccaacctctttaccctcacgataaattttcaaaaatgttattgggtccatgctctaacttgtcatatatttttcaatcaactacagtatgacttgcattcatcccaaaagtcctataactaaggtcatcaacagtctcctagacactcaagaaaatgagtcataatctgtccttaatttagttgatctcactaaaacattagagatagtagtttaaagatgctgcattcaatggctccataaaaccattctctggccaggtgcagtagctcacaactgtaatcccagcactttgggaggccaaggtcagcctattgcttaaactcaggagtttgagaccagcctgggcaacatgcgacaaaaagcagtcagtcgggcatggtggtacatgcctgtggtcccagctacttgggaggctgaggtaggaggatcacttgagaccagcgggaggttgaggctacagtgagctgtgattgttccactgcactccagcctgggtgacagagtgagaccctgtctaaaaacaaacgaacaaacaaaaaccatttttccatggttctcatcctatcattcagagatctccttcacaataaccttcactagctttctttgcccatcccatacatgctgtgatcccagagttctgtgtctaatttattttcattttacatgctttctctggatgatccaatgtattagtttttcaaataataagttttgcttacaaaatctacatctatagtccaaattgctcccttggcctccaaacccattacaaaacaaaatgaatagccctacttccaattcaacatgtccattattattaactaaacttactatgttacccctaatacgtgctccaatgaagcccaagtaatggagaggcattgcagaagccagcttcttgtgaaggcatttgagccaactgaaggagaaggttggtatcattgttaaaatctggctggcacaagaaaaacaggacattaggtacagatgtttcattttctgccataagactgtctccagctggaaacaacttaaactctaagtaagtacaaaggctgaaattcagtgatggcactagtggtctgagtgaacagtgaaacagaaagtgggagaaaagttcaaccttaaaagcctttttatgaataacaagtgccacacgccacacagaatagcaagtcctggtgcttataagcacaacctacaattggtacaggggacctgatcacagtgagctcataatatggtacttgtgccaagcagaaaagcggtattgtgcctcaattaatttcaggatgccaaaaccaacatggaaagaaaaaattcagtacatttgtaacattccctgacatgccctttactactcttaagccataaaactaggagaatataaattttccctttcactttttcctaatgagaaaatatttcaacaggaattcacaaacactctcaaagtatcaatgctgattcttaatactagaaaaatataaacttatccctgtacagataaagaaataaggaatgatactatatatagatatagatatagatatagatatatagatataaagcctaaaggaagaccaatcaaatgtcctcctgtaaaagaaaattactttagggggtgacgtcagatgtcagcaagactctccttctctcaatggacacataaattcaacaacaatacatagaccaaaatttcctttgtgagacatccagagaccagatgagaggctcctgtactccaggcaagcatgaaaccaaccacactgaagccagtaggaaaatttgtggaatcctcttgcgccataagcaaggttacttaagggacttgttgctgtcttgcctgaatcttagctgtgacaggaaagggtcccaggttgggaactgctgagaacgaagcctccagtttggactagtatgcagtaactgaccatagcccctcccaccagctcagaactagcaggtggaaacccccagtcccaacttctccctggggaacgaaaaagctgaagcatctgtccaacattctggcttttggaaggggctgcctaagggaccggattctgcaagtactcacaggactggtattctctaaatgcctggggaccactgagaacaaaggtggtggtttggactagtaaacactcacggccagagctcctacccctggctcagcacaattagaaaaactcatggtccacagcttctccctggggagggaaagagaaaactaaagcatatatccaacattcagactcttgggggactgcccaaggaacttgtttctgtctcatctgtcttgaagcactggtgggacgcagcataaactaagtgcctaggggcagctgaaactaaaaaagcaagtaataaccaaaaaaggattgagccagtgtgctactagctccagaaggcccatggtacaagacacagaataagaaggaacaagagattatgatctcctaaaaacagaaaccagaaaatcccactatttagaaatttacacacagaagtccagagaagacatatccacagaaaaagtttatgaggaccccagaatctctactcaggccgattcttgaaggtctgcccctgtacaaagccaatccataaagactgggagaagcggctgtttttcaaatatgcagacattaacacaaagggtcaaggaaaatgaaaaatggcccaaagaaaggaacaaaataaatctccagaaaccaaccctaaagaaatgaaggtaaatggattagctggtaagaattaaaaacaaccataatcaaaatattcaataagcttaggataaattatgcataaacaaaatgagtattttaacaaacaaaatatttttaaaaagaaaaatttgagggctgaagaatacaataactgaactaaaaacttaactaaaggggctcaacagcagccttgatcaagtacaagaaagaatcagtaaactcaaagacaggacatttgaaattatacattccacaagagcaaaaatgtttttaaaagactgaagaaaacataagaaacttatgagacactatcaagcaggccaatttacatattactaaagttagagaaagagaagagagagaaaagcagtaagcttatttaaagaactaatctgaagagaaaaatggacatccagatttatgaagctcaaagaatcccaagtaggttgaatgtaaagagatctacaccaggacacattataatcaaattgccaaaagtcaaagacaaagaattttgaaatcaaaaagagaaaagcaactcactacatacaaaggagactcataaaactgtaaaaggatttttcaacagaaactttataggccaggagagaatgggatgatatatgcaaagtactgaaagagaaaaactgccagtcaaggatattattatataccatgcaaatctgtcctttaaaaatgaaagagagatacggtcccagataaacaaaagttgaaggagttcatcaccactacacttgacttaaaagaaattctaaagggagttcttcaagttgaaatgaaaggacactagttagtagcatgaaaacacatgaaaatatgaaactcactgataaaattatatataaaatacagattactctattgatataatagtggtgcataaatcattttcaacttcaacataaaaatgaaaagatgaaagtcttaaaaataactataacagttactgaaacaccaggagtccagtctaggtcccattgctcaccgcacagaaagtcaatcaatgagatcaatgagacaatgagtattgctagggaagaaggctttatttgggcactgcagccaagcagatgggagatcagtatcaaatccatctcctcgcccaactaaaattagtttatatagcaggaagaactgtaactacctgtgggaaaacaggaattagggactggtaaggaagaggagttcgtcaacaggaagcaggtggttggtcaggcaatcatgataggtgaggggtctggcataacattgtctagatgcagtgatctggtaagtttcagttccttgatactatctgggatacctgatggttggtttccagagacaggaactcaaataagacaaacgttaagtttctccagtgttaagactgggtgggttaatttctatgtttattcaaaaaaaccataaacatccattttatgggacaacttggatggtttcataccacaaaataatttgttaatgaatacagaatattaaaaggtgaaaatcgggacattaataacaaagtgtgtgagtaaaagtattgaattttttaatgcaatcgaagttatcagcttaaaataggttgttacaactataagatgatttatgtaagccttatggtaacacaaattctttaaatatagtaagtacacaaaacataaaaaaaaagaatcaaagcaaaccacagtaacaataaacacatcatcaaatcacaaagaaatataaggaagaaatgaacaaaggaattatataacagtcagaaagcaattaacaaaatgacttattaagtccacaaatgtgtgaaaattaaacaacaaattctcatcaatcaatgagtcaaataagaaagcaaaataaaggaaattagaaaacatcttgagacaaatgaaaacaaaaacacaacataccaaaatgtgtaggattcagtgaaagcagtgctaagaggaaaatttacaactgtaaaagcttatattaaaaaagaaaaaaaactctaacaacctagatgcacaccttaaggaactaaaaaaagaacaaactaaactcaaagccagcagaaggaagtaaatattaatagtaaggattagggcagggataaaacagaaaatagaaaaacaacagagaaaatgaaactaagagttgatttattgaaatgatcaacaaaattgaaaaacctttggctacacagaataagaaaaaaggagagaagactaaacaactaaaatcagaaatgaaagataagacattacactcaatttaacagaaataaaaagaatgactgggtgcagtggctcatgcctgtaatcccaacactttgggaggctgaggcaggaggactgctggagcccaggagtacatgaccagcctcagcaacatagtgagcctcatttctacaaaaaaataaaaataataaaaattagctggatgtggtggcacacacctgaggtcccagctacttgggaggatgaggtaggattgcttcagcccaagatgtcaaggcggcagtgagcagtgattgcaccactgtgctccagtccgggtgacagagtgagaatctatctcaagagaaaaaaaaaagttataaaaagaactgtaagaaagtactatgagcaacagtatgccaatgtattggataacccagatgagatgaccaaattactcgaaatgcaaaacttaccaagattgaatcatgaagaatagaaaatatgaacagaccaataactagtaaggaaactgaatcagtaattaaaaatctcccaaccaagaaaagcccagaaccagatgacttcactggtgaattctaccaaacatttgagaagtgatgccaatcctcctcaaacccattcaaaacactgaagagggaatactcccaaattcattttacaaagccagcattaccctgataccaaaaccagacaaagacactacaataaaggaaaattacaagccaatacctgaataacatagatgcaaaaatcctcaacaaaatactagcaaactgaattccatggcacattaaaagaatcatacaccataatcaagtgggatttatccctaagatgccaggatggtacaatatatgctaaataataaatgcgataccccacattaacagaatgaagaatagagattatatgatcatttggatcgatgcagaaagagcatgacgaaattcaatatttttttatgataaaaactcaataaattcagtacagaaggaatgtacatcagaataataaaatgcatatatgacaaagcccatacctagcataatactcgaacagtgaaaagctaaaaaaagcttttcctctaagatcaagaacaaggcaagaaggctcactgtcaccacctattaaatagtacagcagtcctagccagagtagtcaggcaagagaaaggcatccaaatcagaaagtaaaaaggaaaatggtttctatttgcagatgacataattgtatatgcagaaaaccctaaagactgcattaaataactatttaaactaataaatgaattcagtaaaatttcaggatacaaaaccaacatacaaaaatcagtagcacttctttacactaacaatgaattatccaaaaagaaatcaagagagcagtcccatttactgttatttttgctcttgttgccaaggctggggtgcaatggtgcaatcttggctcactgcaacctccacctcctgggttcaagcaattctcctgcctccccgagtggctgggattacaggcacacaccaccacgcctggctaattttttttttatttttatttttagtagagttggggttttgccatgttggtcaggctggtctcaaactcctgatctcaagtgatctgcccgcctcagcctcccaaagtgctgggattacaggtgtgagccaccgtgcccagccttaagttcattctttcaggctcttttcagtataatcttgatgagcattgtgagtactacttctttattgcttctccagtttctgtttgtttcctcttggaattcatattatctctgtattggggattttgaatctatattcttcatctcttacacttccatttgttatagccatctttttattttttcctttgttttctcagaaaattttttgagctggttttctaattcactgatttgattttctgtaatatttaatctgctgttttctgtaatatttaatctgctgttttctgtttccattgtgattttcagatttagtaatcatgtttttcaattgtaagcacatttttatgatcagactgttcatccccttttcacatatgaaatgtctacttgaatcatattgaaaaaaattaaataaacattttagaaatttctctttttaaaatagtttttttcttttattgtggtaaaaatacacaacatgagatctacttaagattttaagtgtacagcacagtattgcagctataatcacagtgttgtgcagcagacttctagaacgttttcatcttctgtagctgaaattttatatgcattgaacagcaactccccattttccccgtctgtaagcccctggcagctaccattctactctcctcttctatgggtttgactactatatagtatttatcctattgtgattggctatttaactcagcaaaagtcctccagcttcatctatcttgtcacatatgatagcatttccttttattaatgttgaaaaatattctattttatgtatataccatattttgttaatccattcatttgtagatgaacatataggttgtttccacatcctgactattgtgaataatgctgcagtgaacacaggagtacagacagctttttgagatcctgatttttctttagctttacacccagaagagggatttgctggatcataaggtaattctatttttgattttttgaggaacttccacactgttttccataatggctatatcaatttatgttcctaccaacagtggacaaagattcccttttctccaaatcctggacaacacttgatatcttttgtctttttgataatagtcattctaacaggtgtgagtgatagctcatgtggttttgatttgcattttgctgatgatgcgtgatgttgaacattttatatattgtatgtccactttggagaaacgtgtattcaagttctttgcccatcttaaaattgggttgttttggggcagttgagttgagtactttatatagattgaatattaacctattattacatatgtggcttgcaaatattttatctgattctgtagcttgtctcttcactctgttgattgtttgctgtgcaggagatttttaagttgataaaatcccatttgtctatctttgctttagttgcctatgttttggggttatatctaagaaattactgcctagaccaatgtcaagaagctttccccctacgttttcttctagtcgtttacagtttcagatcttatgtttaagtctttaacgcatttctagttgatttttgtgtatggtgcaagataagggccaaattttctttttatgcttgtggacttccggttttcctaacaccatttattgaagtgattatccattaaccattgtgtgttcttggcacctctgtcaaagatcagttgactgtaaatgcgtgggtttatttctgggctctttattttgttccattggtctatatgtctgtctttacgccagtatcatactgtttcaattactatagatttgtaatacattttgaaatcaggaagtatcatttctccggctttgttcttcttgctcaagattgctttggctatttggagtcttttgtgattccatgaattttcatattttttttattgttgtgaaaaaagccgttggagttttgatagggattgcattgaaattgtagattgctttgtgtatggacattttaacaatattaattcttccaatccatgagcacaggatatctttccatttatctgtgtcttcagtttctttcactgatgttttacagttttcagtgtatagatcttttccacctttggttaaatttattcctaggtattttatttgatttttgttgccaaatggattattttagctgtgtatgaaacagaagaaatcaagagaaatgaagcagagaagacaaggctcagatttcaagcagggtccagagatatattcatatgtccaacataggatatataagatggtaaaagcaaattatttttcattctcagcttcttccactagcaaaaggctctgaaggaagaaacaatccaagggcaaagatcaaatccaaggttttgccagtaaaatatggactcaggatcaaaatttcaaggacacatctttacacacttggttaagacctcagaaagatttgggcagtgcctgaaaaaagcaaaacaaaaaggcttctaaacgtttccatgttgtacctcttagaagctctctgacagataagagggattctaagaatcataagggtgttgtactacagtatcctgattcctggaccaaaacagagaaagtctgtctcaaagaaattcgtgaatacggtgtttgtctaatggaatggattacaattcgatacacagaaaggtgcaaaatttttaaaggaattatagcttcatttgaaagagttcaaaatgaaaatatgcatttggttccccaaattcatacaaacagaaagcaggctgaaaaaactattcagctgaaagcaaattatttcttgtggtaacagaaacatagctcagagggaagagccaagatcatgaaaaacagagcaaacagccatgaagaaccactcccaagaaacagcactaagacctatcatgaaacgggcaacaaatgcctggctagatttcagaactgctataaactatcattgcaatctgcctcctatttctctgctctttgaatgggaaagtttactgcagttctccggtccctctctcaccattgttggctgtgtaggtgagtgtgtgggaaagaataatgccttcctttagttcacaggttcaggctgaaagaagccacaccatggaagacagccacacctgtacctgatttttattgtttactgaggtatagcttgcatacagtaaaaccatatccttgtaaaatgcagagtttgatgagttttgacaaaagtacacacctgtgtaaccacaataaatatacatattattttcatcacacccaaaaattctttgagcctgagagttaagagtcaacttacctcttcctccaattccagacaagcagtattttcaagagtctcatatgtatgaaattaaacagtatgtacatgtttatgtctcgcttggcctggccaagaatatttctgagatttctccatgttgttgcacgtatcaaaagtttattattggccaggtgcagtggctcatacctgtaatcccagcactttgggaggccgaggcaggcagatcacctgaggtcaagagttcaggaccagcctggccatcatcatgaaaccccatctctactaaaaatacaaaatttagccgggtatggtgctgcacacttgcagtctcagctactccagaggctgaggcaggagaattgcttgaacccaggaggtggaggttgcagtgagctgaaatcgcaccactgcactccagtgtgagcaacagagcaaggctccacctcaaaaacaaaacaaaaaaaaggttcattattgctttgtagtattccattatatacataaaccataatttgcttttctattcatgtgtttatggacatttagattgtttacccctttgggttattatgaataaagctgctatgaacattcaagtatttatgtggacatatgttttcatttctctttaccaagtatctaggaatagaattgctgggtcatatggtaagttgtcttaaaatttataagaaatagccaaactgttttccagagtggttgtgcaatattatactcccatcaacagtgtatgagactttcagcttcatcacctcaccaccatacttggttttctcagtctttataattttagccatttataaattttagtctttataatcctaaggggtatgcagtggtatcacactgtgctttataatttgcatttccctgctaaagaatgctgttggccatcttttcatgtatgtatactagccatttacatattttctcttgtgaagtgtctgtaaactcttttgcacattaactggattgtgtgctcccttaagttgtaagaatcctttatgtattctagccacaagtcctttatcagatatatgtgatgaaaatttttctcccattctgtaccctgccaggtaattttccaaatggtgccttttttaaaaaaaggtttagatagttcagtttgtaaattttttcttcattgttttgtgtttttttatatcttattttagaaatctttgcctgttccaacgtcacagagattttctgttttcttctagaaactctatacttttagcattttcatttaggcctataactcatttcagtttttccccagtggatattcagttcttacagcataatttgataaaaagaccttctttccctcaattccactgccatctttgtggaaaatcaaatgaccatgtatatgagggctcacttctggaatttctattctattctataaatccatctatcctttcaccaatactactgtcttcattactacagcttgattttaagcctaaaaatcaggaaagtgaagtcccctaactttctcttcttttctataattgctttcattcctcatggataatgaatcaggctgaggaagttcccttctattcctaatttgctgagagtttttaacatggatgagtgttgcatcttgttatatgctttttctgtatctagtgagatgattacattatatttctaaaactatgatgaaatacataaattttcaaatgttaatctcaaattattcaaaatataatattatttccatatattaatagatctgatttgataattaagaattttaaaatctatgttaataagggaatgctgctaggtaggtttctgttcttgtaaggtctttgtcttcttttggaagcagagtaatactgacctaacaaaatgacttgggaagcattccctccttctctatttcatgtaggaaaaaaaactcagggaagattgataaaatttcttccataaaagccttaaagaattcaccagtgataccatctgggcttaagagatttgtgaggtggttaattatgaattcaatttctttggtatatatagagctattcagatttcccatttcttgagtcagtatttagtttttctgtctttcaagcagtgtgtctatttcatcaacaatgtcactggtataaagtggtttataacattctcttatcttcttaacatctgtaggatctgtgtcaagtcccttctttcattcccgatattattatatcttctttttaaaatgttttattatcaattgtggtaaaatacatataacacaaaatttacagtcttaatcatttttaagcatacggttcagtggtattaagtatattcacattgttgtgcaataatctccaccatctgtctccagatttcaacctgaaaaactgaaaccctacagtcattaaacaataactccctattccctgcttcccactgcccctataaccaccattctactttccgtttctatgaatttgacaactttagagacctcatataagttaaacggtatctgtctttttgtgactggtttattcacttagcataatgtcttcaagatttatccatgttgtcccatgtgacaagactttcttcctttttagggctgaatattattcattctaaatgtaccacattttgctaatctattcatctgtagatagacatttatgttgcttctacctcctgactattgcaaataatgctgctatgaagatgaatatgcaaatatctcttcaagaccctgctttcaattcttttggatgtaaaaagaattcccagaagtgggaatgttggataatgtaattctatttttaattttttgaggactaccatgtcatttccaacagcagctgtaccattttacattcttaccaacagtgcacagggctccaatttctccacattctcaccaacactttttttttcacagtagccatcctcatggatgtaaggtaacatctcatcatagttttgatttttatttccctaatggttagtgatgttgagcaacttttcatgtgcttattggccatttttatatcatctttggagatatgtctattcaagtcctttccccatcttttaatctagttttttttattgttgttgagatgagttctttacatattcgggatattaaccccttttcaaatatatgctttgcaaatatattcttccattccattgactgctttttcactcagttgattatgtcctttgatgtacagtttttaattttgatgtagatagtttttaattttgatgtagttcaatgtatctttttttttatttgtctgtatatttggcctcatatccaaaaaagaaatcactgccaagaccaatgtcataaagcttttccctatgtcttccgtatgtttccctattatagctcttatgtttaggtctttgatccatttttagttaatttatatatgatgtaaagtgagagtccaacttaattctattgcatttggatatccttttttcccaacaccatttgtggaaatgactgtccttttcccaatgaatggtcatagcacccttatcgaaaattatgtgaccatatatgtcagggtttatttctgggctattgtattccattggtctatatatttgtctttataccagtaccacactgttttgataacagtggctttgcagcaagtttccaaatcaggaaatgtaagacctccaacttcgttttttttctaaatttgttttagctactcaatgtcccaagtgattccatgtgaacttcaggatactgtattagtctgttttcacactgctgataaagacatacccagattggggagaaaaataggtttaatggactcacaggtccacatggctggggaggccgcacaatcatggcagaaggcaaaaggcacttcttacatggaggcagcaagagaaaatgagaatcaagagaaagggtttccccttataaaaccatcagatctagtgagacttatttactaccacaagaacagtatggaggaaacagccatgattcaattatctcccactgaggccctcccacaacatgtgggaattatgggagctataattcaaggtaagatttgggtggggatacagcctaaccatatcagatgcatttttctatttctgaaaaaaatacactgttggaattttgacagagattgtatggcatctgtagattatcttgggtagtattaaccgcctaataatattaagtcttccaatccatgaatacaggatgtttttcattcattggtgtctttttagattctttcatcaaggttttgtagttctcagtgtacaagtccttcacctccttagttaggcttattcctaagtaatttattctttttgatgctattgtaaatgagattattctcttaatttgcttttcagattgttcattgttagcatataaaaatttaattaattttttgcactgattttgtatcctgcaactaagctaaatccatttgttagttctaacagcttttgtgaaatccttagggttttctacatataagatcatgtctgtgaacaaagataattttccttcttccttttcattttggatgactttttctttttctttttcttgcgaattgcctatgttgaatacacaaggcaaaagacagcatcctttctttgttcctgatcttagaggaaaagctttcagtctttcactataagaataatgtctataggctttaaatagatggcgtttattttgctgaggtaatttccttatcttcccaatttaagtttcttcttatcaaaaaagggagttaaactttgtgaaaagatttttctacctcaattaagatgattgtgtgagggttttctcctttgattctgttaatgctaatgtagtatatcacatttactgattttcatatttggaaccattcttgcaagttacgaataaatctcatttggtcatgatgtgtaaacctttaatgtgctgttgaattcagtttacaagtattttcctgaggcctttgcagcaaatatttgtcaggatattggcctatagttttctttccttgtaccacatttgtctagttttagtatcaacttaatgctggcctcacgtgataaatttagaagtgtttcctcttcaatgtttttgaaaagtttgaagagggattggcattaattcttctttaaatgtttggtaaattcaccaatgaagccacctggtcctgagtttttgtctgttgagaggtttttgattattgattcaatctgcttactaaaggtctgttcagatattctattcttcataatttagtcttggtaggtcatgtgttgtgagaaatttgttcatttcacctaggttatcaaatatattgacatatggttgctcatagtcctctcttacaaccctttttctttgtgttaaatttctctctgattttagttaatgagtcttgtttctttttttcttacccatgtagttaaaagtttgctcattttgctgatcttttcaaaaacccaactcttagtttcattttctctactgtttttctgtttcatattttatttccttccttctgttagctttaggtttagtttgttctttttctagttccttaaggtgtaaatttagggtttttttttttgtttgtttgtttttttttttttttttttttgagatggagtctcactctgtctcctaggctggagtacagtggtgtgatctctcagctcactgcaacctctgcctcccaggttcaagtgattctcctgcctcggcctcccgagtagctggcactacgggcgcatgctatcatgcccagctaattttttttttttttttttttaagtagagacaaggtttcacccggttagccaggatggtctcgatctctcgacctcatgatccgcccacctcggcctcccaaagtactgggattacaggcgtgagccaccgcgcccggccttttttttttttttttaagatggagtctcactgtgtcacccaggctggagtgcagtggcacgatcttggctcactgttagctccacctcccaagctccagcaattcttgtgactcagcctcccaaggagatgggactacagacatgtgccaccatgcccagctaatttttttttgttatttttacaatacaaaatacagtacaatacccctagtagagacggggtttcaccattttggcgaggctggtcttgaactcctgacctcaagcgatctgcctgcctcatcctcccaaactgctgggattataggcgtgagccatcgcacccagccactggagtgttctttatgtctgttaggttcaactggtctattgaattgttcaagtcctctgtttagtaaccttctgtcatttgttctatccggcgtattgaagttccccacactggagtatgtgcattctacagttattggatggggtattttataaatgtcaattaggctgtggtagttcagagtattcctcaaatcttctacatcctttttgactttttggtcaagttgctccatcaattcccaagaaaaggaataataaatgcaataatgtttatgcatttgtctgtttttccctttggtactattagtttttgcttcatgtatttttgaagctcttttgtttgctaaatacacatttataatcattacatcatgcttatgaatagactctttaccattacaaaatgactatttgtcttataatttttccttgttgtgaaagtctattttatctgatattcagtatagccattccagcttttttatgcttattgtttccatgatacatctctttgcatccttttactttcaagctatttatctttgtatttaaagtatgtctcttataaataatataaagttggctcttgctttttttatccaatccaaaaagcactgtctttggcttccagtgttgagttcatttatatttaatgtaattatttatggttctatttagtctgtcattttgctattggttttgtcacagctcttctttgctcctcgtttttccttccctgccttattttatgttcactgaatattttatagtattccattttaatccttctagttacacatccttctagctatacctagctatatgtcttttcattatatgcttagtatttgttctaagtatgtgctaggcaacatctaagatggctcccaattttccccaactcctggtatgcatgcccatgtggtatgtcctttcccttgagtatagtctggacctagaaacttgcttttaataaacagaatccgacaaaagtgataagctataatttccaagattagcttacaaaaagattctagcttccatcatgcttacctctctcttgctctcttacttgtccactttgatggaagccagctgccatgctgtaggctatcctatagagaggcccaaataggaaaaaactgagagaaacttttggatgacagccagcaaagactgacgccctcagagcaataccccagcaaggacctgaatcctattaaccatatgagtgagaatagaagtggattctcccccaatctagacttcagctgggaccacaaccccagtcaatactttgtttgcaaccttataggagaacctaagccagaaaacccagctaagccatgtccatgagaaaaaaattaaaaaattttaaaaaaattaaaaaataaatgttgctttaagctgctaagatttagagtaatttgtaatggaatttctcttagatgttgcctagcacatacttagaacaaatactaagcatataatgaaaacacgtatagctaggtatagctagaaagacatgcaatagataactgcagatatctgtattatagataatacagattttggtatctgaaagtaaagtacagcctaagaatatggaaacatctttgtgtgtagtgtgctaaagacaaagttgatttgaagaggtcattagtaggaatctggaatttgaggatattgccagtggggctcaagaggaagtaagaaatctgttatcggaaatgagaagaagggggatcctttttacatagagatagaaagctataccatcatcttcagtaacacaaaaattagaaaatatgcttgaggaactaagtgagtaatatagctaagaagatttacaaagtatttgctattgctttaagtgctgtcgctcttaggtgcaagagtagagtaaaattgagtcaaggaaagttaaagaaaatggaactaagacttcatggttttaaaaattctcagcctctctagatggcaaaatatcctaaattaagaaagtccaagcaaactttggacactgcatagacataaagccaagggtataaatgtaaaatattttgtgaagatcgaaaagataaaagatggtatatctcagagtactatgcattcatccacagatccccttaaaaagattaagagtatgcctgacagatcctctcaatcaaacaagagggcctctacaaaacttaagaatgacttaactaagaaaattccactacttgcctatctggatttcagaattgttatgaactagtgactttttagaaatgtctgtggaggttatcctctgcttggcccattgtatgttgggtgtgttaggagcagataactattagaacagacatttcttcaaagaagatatacaaatggctaataagcacatgacaagatgctcagtgtcattagtcactgggggaatgcaaattaaaaccacaatgagataccactgcataccaactaaaatgcacaaaatcaaagccactgacaataccaagagttgatgaggacgtgaagagacgagaatactcatgtgaagagactggaatattggtaatggggatacaaaatggaacagccagtttggaaaagagtttgatgattttttaagttaaaaataaatttaccacacaacccactcttagatatccatccaaaagaaatgaaaaacatatgtccgaataaaaatttgcaatgaacttccaaaacagcaacattcataatagccaaatactgaaaacaatccaaatatccattaactggtgaatggataaacaaaatgtggtatactcatcaatgaaataccactcaggaacacgaaggaatgaactactgatacaagaaacaatatgaacttcaaaaacaatattgtaagtggaagaactagatacataggactacgtattacccatgaaatttctagaaaaggccaaaaaaaaaaaaaaaaaagataattgcttgcctggggctctgggtataagtccatattataaagatatcaattcttcttaatttatctatagattcaatgcattcataataaaatatctcaacatgcacgcacacatgcacacatcacatttatatgcaagtaaaaactggtgagctaatcctgaaatgtatatggaaatgcaaagaaccaagaatagccaaggcaatcttgaggaagaaaaagaaagctggaggacctacactacactataaaatatcaagatttattttaaagctacagtattaaggcagtgtagtattagcacatagataaacaggccaatgaaagaaactagagaccagaaaaaacccacacaaacaagatctcctggtttacacaaatggtgccaagggccgggtgtggtggctcacacctgtaatcccagtactttgggaggcagaggtgggtggactgcttgaggtcaggagttcgagaccagcctgaccaacagaatgaaaccctatctctactaagaaaaaaaaaaaaaaaaaatacaaaaatcagccaggtgtggtggcacatgcctgtagtcccacctattcaggaggctgaggcaggagaatctcttgaacatgggaggtggaggttgcagtgagccaagatcacgccactgcactccagcctagcaacagagtgagactccgtctcaaaaaaaagggggggccaactacagcagtgtgaatgacatttaaaaataatgctaggctgggcacggtggctcatgtctttaatcacagcactttggaaggccgagatgggcagatcacttgaggtcaagagttcaagactagcctggttaacatggtgaaaccccgtctctactaaaaatacaaaaattagctgggtgtgggggggggagcctgtaatctcagctactcagaaggctgaggcaggagaatcacttaagcccgggaggcagaggttgcagtgagccaagatcgtgccactgcactccagtctaggtgacagagcgagactctgtgtagaaaaaataaataaaataaaataaaaataatgctagatcaaacacatatccattgtgatagacagagggaattagccatgacccctacctcacttcatacataaaaatcaattccagatgtaccacatacctaaatgagaaaggtaaaataagaagcttctagaaaataacatagatgagtactctctgatcttgtaacaggcgaggtaagaaatctcaaacaggaaacaaaaaaaaacaacagagtcaactgacaaaactatattaaaattaataacattcaacagaagataccagttgctatggtttctctgctccaaaactcatatttaaatttaattgccattataacaatattaagaggtgtgacctttaagaggtagttaggccatgaaggctttgccctcataaacaattattgccaaagtggattagttatagaagggctagttaggcccacttctctttctccctccctccctctctctctctcttctcactttctgccataggatgatacaacaagaaggtcctcatcagatgccagcaccttgattctggatttctcagcctccagaactgtgagtcagggccaaatagaaacagctccagtcaggagctcccagtgaaatcaatgcagaaggcaggtgatttctgcatttccaactgaggtacccggctaatctcactgggactggttagacagtgggtgcagcccacagagggcgagccgaagcagggtggggtgatgcctcacacaggaagtacaaggggtcagggaactccctcccctagccaacagaagccatgagggactgtgccgtgagggacagtgcattctgacccagttactagacttttcccatggtcttcacaacccacagaccaggagattcccttaggtgcctacaccaccagggccctgggtttcaagcacaaaactgggtggctgtttgggcagacatcgagatagctgtaggaggttttttttttttcataccccagtggcacctggaatgccagcgagacagaaccgttcactcccctggaaagggggctgaagccagggagccaagtggtctagttcactggatcccacccccacagagcccaacaagctaagatccaacggcttgaaattctcactgccagcacagcagtctgaagtcgacctgggatgcttgagcttggttgggggagaggcatccgccattactgaggcttgagtagccgggtttcccctcacaatgggcaagttcgaactgggcaaagcccactgcagctcagcaaagtcaatgtaaccagactgcctctctagattcctcctctctgggcagggcatctctgaaagaaaggcagcagccccagtcaggggcttatagataaaactcccatctccctgggacagagcacctgggggaaggggcggctgtgggcgcagctccagaagacttaaaccttccttcctgttggctctgaagagagcagtggatctcccagcacagtgtttgagctctgctaagggacaggctgcctcctcaagtgggtccctgactcccatgcctcctgactgggagataactcccagcaggggtcgacagaaacctcatacaggagagctccggctggcatctggcggatgcccctctgggacaaagcttccagaggaaggaacagacagcaatctttgctgttctgcagcctccactggcgatacccaggcaaacagggtctgaagtggacctccagaaaactccagcagacctgcagcagaggggcctattagaaggaaaactaacaaatagaaaggaatagcatcaacatcaacaaaaagggtgtccacacagaaaccccatctgaaggtcaccaacatcaaagaccaaaggtagataaagccatgaagatgaggaaaaaccagcacaaaaaggctgaaaattccaaaaaccagaacgcctcttctcctccaaaggatcacaactccttgccagcaagggaacaaagctggacagagaatgagtttgacgaatttacagaagtaggcttcagaaggtgggtaataacaaactcctctgagctaaaggagcatgttctaacccaatgcaaggaagctaagaatcttgaaaaaggttagaggaattgctgactagaataaccagtttagagaagaacataaatgacctgatggagctgaaaaacgcagcacgagaacttcgtgaagcatacgcaagtatcaatagccaaattgatcaagcggaagaaaggatatcagagattaaagatcaacttaatgaaattaagtgtgaagacaagattagagaaaaagaatgaaaaggaacaaagtctccaagaaatatgggactatgtgaaaagaccaaatttacgtctgattggtgtacctgaaagtgacggggagaatggaaccaagttggaaaacactcttcaggatattatccaggcaaacttccccaacctggcaagacaaaccaatattcaaattcaggaaatacagagagcactacaaagacactcctcaagaagagcaaccccaagacacataattgtcagattcaccaaggttgcaatgaaggaaaaaatgttaagggcagccagagagaaaggtcacgttacccacaaagggaagcccatcagactaacatcggatctcttggcagaaaccctacaagccagaagagagtgggggccaatattcaacattcttaaagaaaagaattttcaatccagaatttcatatccagccaaactaagcttcataagtgaaggagaaataaaatcctttacagacgagcaaatgttgagagattttgtcaccaccaggcctgccttacaagagctcctgaaggaaacactaaatatggaaacgaaaaaccagtaccagccactgcaaaaacataccaaattataaaaaccatcgacactatgaagaaactgcatcaactaacaggcaaaataaccagctagcatcataatgacaggatcaaattcacacataacaatattaaccttaaatgtaaatggactaaatgccccagttaaaagacacggactgggaaattggataaagagtcaagacccatcagtgtgctgtattcaggagacccatctcacatgcaaagacacaaataggctcaaaataaagagatggaggaatatttaccaagcaaatggaaagcaaaaaaaaaaaaaaaaagcaggggttgcaatcctagtctctgataaaacagactttaaagcaacaaaaatcaaaaaagacaaagaagggcattacataatagtaaagggatcaatgcaataagaagagctaagtatcctaagtatatatgcacccaatacaggagcatccaggttcataaagcaagtttttagagacctacaaagagacttagactcccacacaagaatagtgggagactttaacagcccactgtcaatatcagccagatcaacaagacagaaaattaacaaggagattcaggacttgaactcagctctggaccaaatggacctaacagacatctacagaactctccaccccaaatcaacagaatatacattcttcttagcaccatatcacacttattctaaaatcgtccacataattggaagtaaaacactcctcagcaaatgcaaaagaacagaaatcataataaacagtctctcagaccacagtgtaatcaaattagaactcaggattaagaaactcactcaaaaccgcacaactacatgcaaactgaacaacctgctcctgaatgactactgggtaaataacaaaattaaggcagaaataaagatattcttggctgggcacagtagctcacacctgtaatcccagcactttgggaggccgagggaggcggatcatgaggtcaggagatcgagatcatcctggctaacacagtgaaaacccatctctactaaaaatacaaaaaatgagccgggcgtggtggtgggcgcctgtagtcccagctacacaggaggctgagacaggagaatggcgtgaacccaggaggtggagcttgcagtcagccgagatcgcgccactgcactccagcctggatgacagagcgagactccatctcaaaaaaataaaaaaagaaataaagttgttctttgaaaccaatgagaacaaacacacaatgtaccagattctctgggacacagctaaagcagcgtttagagggaaatttatagcaccaaatgcccacaggaaaaagcaggaaagatctaaaattgacaccctaacatcacaattaaaagaactagagaagcaagagcaaacaaaatcaaaagctagcagaagacaagaaataactaagatcagagcagaactgaaggagatagagacataaaaaacccttcaaaaaatcaatgaatccaggagctggttttttgaaaagattaacaaaatagatagatcactagccagactaataaagaagaaaagagaagaatcaaatagacacaataaaaaatgataaaggggatatcaccactgatcacacagaaatacaaactatcatcagagaatactataaacacctctatgcaaataaactagaagatctagaagaaatggataaattcctggacacatacaccctcccaagactaaaccaggaagaagtcaaaaccctgaatagaccaataacaagttctgaaattgaggcagtaattaatagcctaccaaccaaaaaaagcccaggtccagatggattcacagccgaattctaccataggtgcaaagaggagctgttaccattccttctgaaactattccaaacaatagaaaaagagggactcctccctaactcattttacgaggccagagttatcctgataccaaaacctggcagagacacaaccaaaaaagaaaatttcagaccaatatccctgatgaacatcgatgcaaaaatcgtcaataaaatactggcaaaccgaatccaacagcacatcaaaaagtttatccaccacaatcaagttggcttcatcactgggatgcaaggctggttcaacatatgcaaatcaataaatgtaatccatcacataaatagaaccaatgacaaaaaccacatgattatctcaatagatgcagaaaaggccttcaataaaaattcaacaccccttcatgctaaaaactctcaataaactaggtattgatggaatgtacctcaaaatagtaagagctatttatgataaatacatagctaatatcatactgaaagggcaaaagctgcaagtattccctttgaaaaccggcataagacaagatgacctctctcaccactcctattcaacatagtattgtaagttctggccagggcaatcaggcaagagaaagaaataaagggtattcaaataggaagagaggaagtcaaattgtctctgacatgactgtatatttagaaaaccccattgtctcggcgcaaaaactacttaaggtgataagcaacttcagcaaagtctcaggatacaaaaatcagtgtgcaaaaatcacaagcattcctatacaccaataacagacaaacagagagccaaatcatgagtgaattcccattcacaattgctacaaagagaataaaatatctaggaatgcaacttataaggaatctgagggacctcttcaaggagaactacaaaccactgcccaaggaaatcagagaggacacaaacaaatggaaaaacagtccatgctcatggataggaggaatcaatacagtgaaaatggccatactatccaaagtaatttatggattcaatgctatccccatcaagccaccactgactttcttcacagaattagaaaaaactactttaaatttcatatggaaccaaaaaagagcccacatagccaagacaatcctaagcaaaaagaacaaagctggaggcatcatgctacctgacttcagactatactacaaggctacaataaccaaaacagcatggtactggtaccaaaacagatatataaaccaatggaacagaacagaggcctcagaaataacagcacacatctacaaccatctgatctttgacaaacctgacaaaaacaagcaatggggaaaggatttcctattaaatggtgttgggaaaactggctagccatatgcagaaaactgaaacttgaccccttccttacatcttatacaaaaattaactcaagaaggattaaagatttaaacataagacctaaaaccataaaaaccctagaagaaaacctaggcaatatcattcaggacataggtatgggcaaaggcttcatgattaaaacaccaaaagcaatggaaacaaaagccaaaattgacaaatggaatctaattaaactaaagagcttctgcctagcaaaagaagctatcataagagtgaacagacaacctacagaatgggagaaaatgtttgcaatctatccatctgacacaagactaatatccagaatccacaaggaacttaaagaaatttacaagaaaaaaaaaacatcaaaaagtgggcaaaggatatgaatagacacttctcaaaagaaggtatttatgccaccaacaaacatacgaaaaaaagctcatcatcactggttattagagaaatgcaaatcaaaaccacaatgagataccatctcacaccagttagaatggcaatcactaaaaagtcaagaaacaacagatgctggagaggatgtgaagaaataggaatgcttttacactgttggtgggagtgtaaattagttcaaccattgcagaagacagtgtggaaattcctcaaggatctagaaccagaaataccatttgacctagtaatctcattactgggtatatacccaaaggatataaatcattctactataaagatacatgcacacgtatgtttatttctgcactgttcacaatagcaaagaattggaaccaacccaaatgcccatcaataatagaccggataaagaaaatgtggcacatatacaccatggaatactatgcagccataaaaaaaaggatgagttcatgtcctttgcagggacacggatgaagctggaaaccatcattcttagcaaactaacacaagaacagaaaaccaaacaccgcatgttctcactcataagtgggagttgaacatgagaacacatggacacagggaggggaacatcacacaccgggtctgtcaggggattgggggctaggggagggatagcactaggagaaatacataatgtagattatgggttgatgggtgcagcaaaccaccgtggcatgtgtatacctatgtaacaaacctgcacattctacacatgtatcccagaacttaaagtatattaaaaaaaagaataaaaaaactctgcacgaatttaaaaataagtaaatacatatcacattacactgtaaaaaaaaaacttaaagtataattttcttaaaaatcagatgcagaactgtgagtcaataaattctgttcattataaattacccaatctcaggtattctcttacggcagcacgaaatggaccaagacacaagtgaaagtgaaaatgcaagccacagagtgaaaaaagatatttgcaatacatatattcaacacagaattagtatccagaatatacaaagacaaatcgacagtgaaaagacagacaaaccattttttccatacttaaaaaagatcaaagactcaaccagaaacttcacataagaggatatccaaatcatcgataaacattaaaaaagatcttgatatcattagtcatgaaggaaaatgcaaattcaaactatacatctgccataccagaattgctaaaattattaaaaacttacaaaccgagtttcagcaaggatggagagccatgggaactttcaatcttgctagtggaaatgtaaactggtacagccactttgagaaattttatcagcagtgcctactatgattacacttctaagtcaacactcaaaaaaatgtgtatacttgtgtactaagagacatgtaaaagagtattcacagtagaatcacttgtaatgtcaaaaaccaaaagtccaaccatggtacaatggatatataaattgtgatatattcatacaataattttaaaaatccattgctaaatgcaacaacatggatcaatctcacaacataatgttgagcaaaagaagacagaaacaaaagggaacacgctttatgaatcaaaaacaatgaaaacgaatctatggtaacataatacagaatagtggttccttcttcaagaggtgataaatgactgggagagagcaagaaagagtttctggggaggtagctatattctctatcttgacctggaaagagatttcacagatatatacattttgtaaaacttcatcaagctttacactttgatgtgtcttgttgtatgtgtgttgtattttgattttaacattttaccaaaagacaaagaatgaactatagctatatttattaacatggataaatctgaaaaatatgatgagttaaaggagcaagtctcaaaataatatatacagtatgattccacttacatgaaattcaaaatagagaggtaaataactgattaacacaaaatacaggacagtaatttcctctcaagcaaagggaagaggcaatcggagaagggtacccagcggtcttctggagaactgtaatatactatttattggctaggttgaaagtatagaaatgcttatcttctagtggctctttaaagtgtacctatgcactgtacatgttttttgcatgcatgctatgtttcacagctgtaaaatattttaagagtaatacaactactgaattacaaattatcagaaaaccaaaatgagaacttctgattttctgtcttttcatttatctgagcagcaggtaatattgttatataccatctgcagaacagtcttctttgggtatattactaaatatacttatgaaacataaaaataaataacaattaataatccagtaaagtatcaaataatgctgaaaattaaaaaatgaaaataacttccaaaaatccacaacatacttattttaatttttcaaaaagaactttattagaaagaaaaagaaaactaaatgaaaaaaaatgagatgcttaacaaaactagaaaaaggtgagcacagatccataaacactttaagacttcgtatttccaactacttactttaaaatggcacacttgattttaaaacttaaaaataaaaacaaatttaaaaatcgtacatttaaatcattgtttattaatatatctctgacttagaacactcaatatttaaatttcattaaaattaaatgttaaaatataagctgttatccatttttgtttattaaaaaggacaacccaaactgttcaatattacctgacaaacagaaacttgtgaaattaaaagatgtcattacaaagcctcactcattaaaagaaagaaaaagagaaatgtgactaaattgtcagaaagctgacttactgggggagaaaaaagcctaaatggcccaaggaccattattttcaaagctgctccatcccagttacaaatagttgccacttggcctcatcttagtaaatacctaagagtgacatttaattagcacattaatgttgaaaattaatgagtagctaagaggttttatatgtgtgaaatgttgtattttattgtgtactctaacaagcagttttcacttctcatttatgtagcagtcctatttctagagtacaaggttaagtgtctatcagcaagtgtccattgtataaaagattgtcaaattagtcagatttggccaggcacagtggctcacgcctgtaatcccagcactttgggaggccaaggcgggaggaccatttgaggtcaagagttggagcccaccctggccaacatagcaagaccccgtctctaccaaaaatacaaaaattagccaggcgtggtggcgggcacctgtaatcccagctactcgggaggctggggcaggagaatcactgaacccaggaggcagaggttgcagtgaggggagatcgcgccactgcactccagcctgggcgacagtgcgaaactctatctcaaaaaaaaaaaaaaaaaaatggccagcatggtagctcatgcctgtaatcccagcactttgggaggccgaggcatatggatcacaacgtcaggcattcaagaccagcctggccaagatggtaaagccccgtctctactaaaaatacaaaaattagttgggcgtggtggcaggcgcccgtaatcccagctattcaggaggctgaggcagagaattgcttgaacacagaaggcagaggttgtggtgagccgagatcgtgccattgcactccagcctgggcaacaaagtgaaactccatctcaaaaaaaatatatatatatatacacacatatatgtgtgtgtgtgtgtgtgtgtgtgtgtgtgtgtgtatatttatttataaacagtttcttttttgttagtaggagctcctctgacagcagaaattgaccaagagcaactagatgttgatcatgggtgatcatcaccaaaaaagggagctgcccgtgaaatgcaagtaagcacagaagaaaggtctcccatgtggcagagccagtttctatgcaccagcacccaagccctagtccccattcctaccccacatccccaccgagacagagaacaggccaccagctctccatctggtcagtcaggttttgcaatggccaagcagaagattcggatctggtactgttctgcccaacacagtagcccctaatcacatgtggctatttaagttaattaaaattagaaattcagtttttcaatcacaccagccacatttcaagtgttcaatagtcacgtttactggtggcgactgtattggacagtgccgcctatagaacattaccatcagaaagttctattgaacagtactgctgtagaacacatatctgcccaaacatcagggttattcacaaataaaatgaatgtacttttggcaggtaatatttaagaaggttttactaagaaggaaaggtattgattggctccttgctaaattatccaacaatttcaggaggagcaatttataatgttatatagtatcatttacatataaaagtggagtttaacaaagtaaaaagattcttttgcatgcccagactaaaaaattaaatcaatatttttaaagtgaaaaatgtttgctcacatagattaacttcttcaaccacaagtgggttttcattatacttgatcaccatctgctggccatgttattaaactgcacacacaaatgaaatgctagctatattggggtaagacatacagaatcccagctttttgccacaatgcattcctggaaaaccatatcataaagaggatcattataaagcaagtcacattttccataagggcaggaccataattagaatcttcattccaaactaaaatctagcatcaaataacccatggcaaaatctcattaaagcaaagatgtaaaaactatagtcctctataattatttaaaataggataattattctccaagttctttcttacaggtatgaacacatgtattatttagatgacccaacatgagttaaaagataaatataatttatataaaattagcctaaatctgatatggtaaaaatagtaggtagttaataataattatttgcactctcctagaaatcctaagcaatctggtgtaggctcctaataaaatggcacctaattaaatgccttctttttcatcaataaattcctctcaaataagcagaagcaacgtgtttcttccattgtaaagcagtgtttaaaggtcagggtttatttaacattactcctcttcaccctaccctaacttttaatcaaagttttcagtaaaaataataagtgctattaaatcatttttttacatctttccctatcccagaacctcactgcactttggtgataagctaccagaccacgtatacttcactgaaaagacataaaattactacaagccattaacaagaagcttcaaaacatttttcacagaattgtaaagcaagaatacaacctattacttttgtgttctttgagataaagcatgaagaatatatagatgatgtgaactaaaatcaaaatattagttaccagccgagcacggtggctcacacctgtaatcccagcactttgggaggccgagggagggggatcacctgaggtcaggagttcgagaccagcctggccagcacgatgaaacctcgtgtctactaaaaataaaaataaaaaaattagccaggcgtggtggcacacgcctgtaatcccagctactcaggaggctgaggcagaagaatcgcttgaacccgggaggcagaggttgcagtgagccgagatcgtgccactgcactccagcctgggtgacagagcaagactccatctcaaaaaaaaaaaaaaaaaaacacacagttacttaggcagcttcaaatatatggcgtgaaaaaatgtaaacaatgaggccagccactgtgtgttccttctatccttgaaaaagaggcctattacattgtttaaagattcctataaagcctcttttaaaatagaattaccattctttattttgatattgtgcaggattcatacttacaatcataacctttctgcagagtcataatttatttttctcagggaatacaaaatgacttttagtaactgaaaataattaatgaccaacagactttaagataataccctttgggaggattagtaattagggaagcaaaagcatggtcaaacaatctaacaagcaaggccctgatgaactattacaataatgatcaccataccagtgatgatggtggtagccgcagctaacacttaacaggccctctgtcaagggctctacacgtcttatttcactttgtccttacaactccatttgcaaatggagatagtggtagtactaaccccgaagttagtactaccactatctccatttacgagtgatgaaactggggtttagagaaattaagtaacttgcctgaggacagatggttgccaagtgtcagaagtggaatgtgaacaaaggcaaactgctttctttcagctcaacctagaaataaccaaaaacaaaggtatagctgcccaggattgctgacgcagcacaagtggaaaaaaacagataaaactgaaatttccatatttgctgcataaagtacttatgcctatatgatacactagaaagaacatgggtgtgaaatcataaggccctgcattccaatattggatccatcactggaaaagtcactggactttcctgaagctgttatcttgtctataaatacaaaagggcaatgatgtcagcctcactggactatagagaggattcaatctgatgacttggaaaagatttctagaacagtacctagcatgcagtaggagatccataaatggtatgacttgcctcacttggcctctgctttcacaaattagaaatacaagtggaatccacaaacatttatttactagaaaattttttatttttatgtttaaatgtatatatatctgttatacaaatttattaatttgcaatgtgtatgcacaaacattttaacaagatgatatttcagaaggcaactgaacagtatctatcaaaataagagtgtgattattagaaataccatagacacattttttttacaagaacgtttttaaatgtacactccaaactagtccaaatccctaaagctaaccacctttaacagtttcatgtgtggtacccagaaagattccctgcacacgaacacatatgtatccacagagcctctaaaacacatatacacaaacacaaacggaagcttcctatactttatgtacttctttttaactttatcctattagatcttgccataataacctatatatatgtgtgtgtatatatatgtgtatatgtgtgtgtgtgtgtatatatatgtatatatatgtgtgtgtatatatgtatatgtgtgtgtatatatgtatatatgtgtgtgtgtatatatatgtatatatgtgtgtgtatatatatgtatatatgtgtgtgtgtgtgtatatatatatatatttttaaccattgcacaagatgttgaaccaactaataactccaccaacaaagcaatttctcacctaggagtccataatagcccaaaacagatgcaggcatataataatccttcttgatattctaactgataatttggcatcttgaaatcatggaccaaactaacagccaaagttgtccacatccttaccattcctgtctttttgtgggcacttggaaattatattacaaaccctccaactacaaaccccaacatcggtatttcactttctgtccaatagggaacatcccaccactatataaaaaggctctcacccatgcttctccttgctacttctgcctcctgaccaacccttgtgcttctccacatggcctgcatggtgtggcatgcctccctcctcttggaaactgtgagaaataaactcttctttcaaaggcaacttgtctctatgtctgtcatcgtataatgtctgattaaaacaaaccctgggtgcatttttaaataaggtgcctgatgatggattactaggatgtaaactcaggcattctttataacaataaaaaattaaaagcagaagagacagattaaattatagtatatccacattatggattatctgtaattgagaagtccacatgatacaggtttaagacatagctgagtaaaaaaaagagcaagtctcagaacagtatgtacattatgagccaatttttaatttcttctttttttttttttttttttgagacagagtctcactctgtcacccaggctggaatgcagtggtgcaatctcagctcactacatcctctggctcctgggttcaagcgattctcctgcctcggcctcccgagtagctgggactacaggcacccaccaccatgcccagctaatttttttgtatttttagtagagacggggtttcaccatattggccaagctggtatcgaactcctgaccttgtgatccgcccgccctggcctcccaaagagctgggattacaggcataagccaccgcacccggcctgtaatttcttaattatataggtgtggatgtctattgtaaaatgatatgcacaaaattgttaatggtgattaccactccaaagtgggataaagaggacacagaaggattgtgactttttactctaaatatttctatattgaggtttttataaacatgtattatatatatagattgcatacttttccaaaatgaggataaagactgtactagtcatctattgctttataacaaattattacaaatttaacagctttaaacaacacacataaatgttctcatgtttctgcaggtcagaagtccaggcacagctgaactgggtcttctgtttagggccacaaaaggctgcaatcatgattggaccagacctgggttctcatctagaggctcaactagggaaggattcacttcccgacttgtgtggatgtcagcagcattccgttccttatggctatctgattcatgtatgatttgtggcagctgcattttccaaaaccagcaaacggaatgacagcaagtctactggcaagatgaagtaatgtaatcctgggaataatatcccattaccattgccataatctattggttagaagcaagtcacaggacctgcccacactcaaggggaggggattatataagggtatgaacaccagaaggaggatcatgaagaccaccaacaagacaattaaggtctttatcagacctccatggtaagtatctgaaggctgatcagaaagataatatatattgatatagctcatgattgtagatctaaatgaaattaaccaaactatacatgcatgagatctaagtctatggtctccttagtaacattttctaaagtcatgctccaaactcaaatataactaaaatatttcattgtcaagaaaataggcagataggccaggcatggtggctcatgcctgtaatcccagcactttgagaggccaaggtgggcatatcacttaaggtcaggaattcgagaccagcctggccaacatggtgaaaccatgtctctaccaaacacaaaaattagccaggcatggtggtacgcacctgtaatcccagctactctggaggctgaggcagaagaatcgcttgaacctgggaggcagaggttgcagtgagccaagactgtgccactgtactctagcctgggtgacagagtaagactctatctcaaaaagaaaaaaaaaagaaaaagaaaataggcagatatttgacataaaaatgcagtaacagatatataatagcaatgcaatgtggaacagtagtttttcttatagaaaatatgggcaataagattatcttaaaccaagaaatatgaaaaatgaaagcaaagaagagaaccaggacaggactactagctaagtgttgaagctgtttggtgtgaaatgctaagtacactagtatataatgtatacttggtggaaaaaataaagcgtgagaataagccagatggagtatgacctcaccatacttctaacaagtttggaacaagactatataccatatcctacaggaagaataaaagtaaaggaaaggtgccatctctactgaatagagagtcctaacaaaaaggcttcaaaaggactctgcatctttaataatataaaaaggctaggacacaaacagcatcatctaaaatgccattagaaatacttcacatacaaaaaggtctaagtaaagcaggattttataaagtgatcaaaaaagaaacactaagggggaaaaatcttttaagattaaagaggtttttcaaaggacaagttgaagtggctgtaaaatttatgaggcagcattaaacttcagttctaagtaacaataaattattcaccataaaaacatacatgtgtcaaatattataagcctcttaaactttttaaaacaatttcttgcagaactgattagatatattaagtcaagattagcagatactaactttttcattagcatactatgatcactcagagtaaaggaggaaatttagaaaagaaataagacagaaccatcaatagtcgattcaccaccaaatgtgatctgatgtcacacatgatacatatttcaccttaagattagtttccttggctttagctaaagtaaatgttagttttatttttaaatgtcttcatgtatgtaaaaactacaaatatctgttaactaatgtaaatcaaattaaaattgtaaaaataatcaagttaaaactattaaattaaaagaaacataagataccctgagatattttgttttggcagccctaattgaccttagtgattctgacatttgacagaggatattttaagcatgtcctttccagctccttcattgtcattcctcacagtgtgtgaagggaatcgctataaactacatctaagcttccctctatattttctaaaatttatgcttccctcaacgttttctgaaatgttaaaaagaaaaaaaaatccttttaggccatttcctctgtcacaatatacccgtttcaaagggattttgtacagattaaattaaatatgtggcagtgtctaacacaatctacttgttcatgaatgcattcactgttgaatatagatacttacagaattcctaacacgttccttcccagtgctaggggctggaaatatagcaaatacagcaaacagcaaaaacacaagttcctacctcatgaaatttacaatctagcacacaggacagatagtaagcctctacacatgggatgaaggcagcaaagaaacacagagtactaaaggagtaaatggcggggtcgcctaaactgccctgggatatcagataaggcttttttcacgttgcaatctctgaaggatgggtaggactcaccagagtgcctgcttttcccattacttattatataactgacaacgaatgcctcatactctagcaatccttttgcattaaaacacctttaataataggtgaccaacaaagagaattaagttattttttacaattgtggggattttactatggttccatttctcaaaaaagtcaatggctaatagttgaaggatattctcattgtattttctcaaactttatcctgtattccaaagaagaaaaaaatctattcacccggactccctggaaatctcaagtctatttcctaccctgaacccttctcttatacacacctgaatccttgcaaatacttccatgactaagcatagccactgcactgaaactatccatgtgctcatctttctcccccactcatctaaaacaatggttataaatcaaaagtctggaggacttaacagatgagtgattatactaccagatataaggatatccttcacttctacaaagacatagtgtctgtctctccccttctgttttttgttcacagatgaggtctcaccctattgctcacgctggcctcacactcctgggcccaagctaacctcctgctcccacctcttgaatagctaggaccacagacgcacaggctgtgcccaatcctctccccttcttaaatcacatgatccctcttttctacctttcttctttcacttgatagaacataaaaatagaaaaacaaatacttcattttcctcttaaccctacttaaaggggaaaaaaaacctcaagctcaataacagatgcaatagacatcaaatttggtgtcaggaattagaaggaaatcatgaaggcatatgctaaggggggtaaccaagcactacttagctccaacatatggctgtctcttagaaagatttctaggtgtccagttttaaagagaagccagaaagttgggcttttatatgaaattccccaaatgttaattttgacaactcatttaaaattgttaaagacattgtttaagtccaaccaagcaaatctacccacacgattcattcagtccaggaagatcacatatttttaaactatgctctaagctctaagatacaggaaactactttagttcacctttatactgtaaactccacattcattacatctagaaagaaacccagaatttagctggactcttagcagatattttggcaaacaactgatgtattttgcagctaaactaagaatcgtatttttctttgtatacagaccacaatctctttatacctccatataaaaagattgcttcaaaggctacaaaaattctacaattacacctcttctaattgtaattctcctatgaatgtaaaaataagtattttaacaccacacttcctacagactcatctattcatttctttttactcttctgaatatgcccttaattatttcacctcttcctttttgcctccccattctgtttctcctttctactgaaataattttatatggactggatctctcacttttatttatctttttcttttcttttttttgagacagactcgccctatcgcccaggctggagtgcagtagtggaatctcggctcactgcaagctccgcctcctgggttcatgccattctcctgcctcagcctcctgagtagctgggactacaggcacccgccaccacgcctggctaattttttgtatttttagtagaggtggggtttcaccatgttagccaggatggtctcgatctcctgacctcgtgatccgcccgcctcagcctcccaaagtgctgggatgacaggcgtgagccaccatgcccggcctgtttatctttttcgaccataatatctcaggtctgaaaaacatataaacagactacatcaactgtggagacatttcaaattactaataacatttctatatctgtttaaggaataaaccaaaaaaattatagtggacaagaaagattatactgttaacagaaacagatttctaaaattaaaattaccaagagaatggtgaggaaggaattataaagtatggtacatggtaattgacactgtcctatattttactaaaacatttcaaggaataaggccaaacagaaaagtaaaaatttgataaaagtccaaatttaaatctatcccttccctaaagccaaaaactatgctaccacaataatggcctttttgaacatttcaaaaatttggaaatttatttttatttgcactaaaaaaacctatttaagtttaatactctagtaagaaagcacagtctaatggggtttacgcttacattcattatatcattaagtgaaaacaaatattgttcaaggtggatttgcaggatattttgttcaagttattgataatgcttttaatgtatgcttgtcataaaggaaaatacataattgtgtcatttaaagatgctcagggaccacttgtcaagcaatcaaaaatatatatgaagttaacaggtatctattaaatggctaaaaatataaaataatcttgaatgtgcagttaagggaaaagtaaactacttccattataaaaaaaaggaaaaacagaatgtataaatcagttccaaagacagactaaatgatgaaacacattcaaaatcccattctctttacatacctgtagacatcagttggcgactgtactaaagtgttatcttctccagaagagagtttccatgattcatttaatttgtgttcacttgtctccagctcacccagtacccaggctggtaatccctctgggcttgaaccttttgctcgtgctggatttggttcatcaaaatagatggactgattttttaaaattagaaaaattattctttcaaaatgtactataataaaccactaaaatttccatcaagtttcaagtttgaaaacagcctttcaaatactcaaattcaattacattcaaacatttaaaaaattaaatgtacattgaattatgagatattaaaatacattaagtgataacatatttacattttagttgcactctactgtctaagaaatacaataaacagaagtacataacagataaatctgatagtaatgtttatattactaaaggaatattagttaaatatgaaaagttaaatacaaagtttttaattatgtgccatcctatctctttctgtaatcactaactactttacatacacaaaaaaagaaatcagtgggatgagaaacacaaacagtgcaacccaggaattaaaattaggaatcccttgataaggtgggaacagcagagtgaaaaacctgggatttagttctggccacactgctaactagctgggaaacccaagagagttctctaaactttcacattattattatttgttaaataaagcccttccctttgattctatgaaattaagtgtgaatgggaaaacatgatacaatgtactcatatcttcacatctagatgtgcttcataaaatgttctacctttacacgtttctaaagaaaactctgcattgactgcacacctctgcaacaattctcccaatcctacagacagaatcctcaaggcactgttctttagggaggatgacacaagaccctccactccatatgggacatgcacagaaatttctttttaaatgacatagtcattaaaacttttggcattgtgccatggaaaacaggaattattctctaatgttcagcgtgccacttgactaaattgtgctttaagtaaactaataaaagttttaaaatacatgacacaagaattctgcagttcattaaaaaaatacatatatatcctaacagcaactatcaaagctaccaatacctagtactccagatttcttaagtacaggcactcaaataccaaacaaaccaaggtatattttatggttacaaggaccagggcagtgacaatttatccaccaagcataataataactgcctttgcaataaagctgattttgacaatgaaattaatttaagtacagaaaatgactttcaaactccattactgtcattttattagagtaaaaaggaacttttacaaatcatgcactccaacctctcataaacgtttaaataatatatatgaaagagtttaaaaactagaatttactgaattacgtaaaaattaccattacaatccagtgaaaattagcaaaaagtaaagctcaatataaaaaatttcgttttcagttttttagaaatactgttgaatactgaggcataactaaatcaataaggatactccccttataagcaatacatgtattttattaaaggtggaaaaaaattgaatcaggaagaaaaaaaacaattttaatatattatctagcacatacaacctaatagtattaccattccccaaagggatgataacttgacgcttttttttaaatgaaactaatatataccttttgttcattgatacctaccatgtatgaaggtagaatttttagtgtcccgggttcaggtcggtgtgtaaaagggccttcaagcgcacctcgtttaagcatatgcaataacaattttgcatacaggttccgattcttcctccccattattcctgcacctgttcctgaaggttcgcacagctttctaatccaaagagcacacctctgccgttctataaatacagaagaactattagaaattttattttttataaaatgaaacattcaattacaaagacctataatagcacctgctttagtctaaaagaaggaccaacaaaccttttctgttaaaggccagagagtatatactttaggcttcacaggccatatgatctctggcataactactctgccactgtagcatgaaagcactcagagaccataagtaaacaaatggcatgactatgttccaataaaacctggcaaaaaaagactgtgggcaggagttggcccatgggccattgtctgctaactcctggtctacaatttcactttattaggtaattggtaaatgagaaagacaaatgcaaagaaatattttctcaaaaataaaatctctagattatcattaaataactttaatttttaattattgtgagtacacagtagatatatatatttaggcagtacatgagatattttgatacaggcatgtaatgtataatagtcgcatcaggataaatcgggtatctatccatcacttcaagcatgtatcctctgtgttacaaacaatccaattatactcttagttatttttaaatatgccattaaattattagtgactgtagtcactctgttgtgctgtcaaatactaggtcgcattcactctatgtttttgtacccattaaccatccctacttcctccccacccatccttcccaccctctggaaaccatccttctatctccatgagttcagttgtcttaatttttagctcccacaaattagtaagaatatatgaagattgtctttctgtgcccagcttatttcacttaacataatgtcccccagttccagccatgttgttgcaaatgacagggtctcattatcttttatggctgaatagtactccattgtgtacatatatcacattttctttatccatttgtctgttgatggacacttaggttgcttccaaatcttggctattgtgaacagtgctgccacaaacatgggagtgcagatatctcttggatacactgatttcctttctttggggtatataactagcagtgggattgctggatcacatggtagctctattttctagtttttctgaggaacctcaaactcttctccgtagtcactccactaatttgcattaacaccaaaagtgtaggagagttaccttttctccacatccttgccagtgtttgttattgcctgtctttggataaaagccattttaactggggtgaaataatatctcactgcagtttttatctgcgttgctctgatgatcagtgatgttgaacatcttgtcacatgcctgtttgccatttgtatgtcttctattgagaaatgtctatttagatcttttgcccatttttaaatcagattatttgatttttttgtatagagttgtttgagctccttatatattctggttattcccttgtcagatgaatagtttgaaaagattttctctcattctctggattgtctcttcactttgttgatcgtttcctttgcagaagctttttaacatgatgagatcccatttgtccattgtcgctttggttgcctgtgcttttggagtattactcaagaaatctctgcccagaccactaccctggagattttccccaatgttttcttttagcagtttccttgtttgaggtcttagatttcagtctttaatccatttttatttttgtatatggtgggagacaagggtctagtttcattcttctgtatacggatattgaaaacttgatatccgtatacagaagaatgcctttaaaaatgtttgcatttttgctgtgaaaattacgtaatcacagaacaaactaatgaaatatcaggattactttgtacaagaagatacaaaagtgaaactgataaacttaagtaaatggcaccatttattgaagagactgtcatttccccagtgtaagtccttcacacctttgtcaaaaatgaaattcctgtaaatgtacggatttgtatctgagtttttaattctgctccataggtccatgtgattgtttttacgccagtaccatgatggtttggttacaattgctctgtagtataatttgaagtcaggtaatgtaattcctccagttttattatttttgctcaggataactttggctattctgggtcttttgtggttccacataaattttaaggttgtttttttctatttctgtgaagaatgtcattggtattttgatagggattgcactgaatctgcagattggtttgggtagtatggacattttaacaatattgattattccaatccatgaacatagggtatctttctgtttttttgtgtcttcttcaatttctttcattaatgttttatagttttcattatagagatctttcacttctttggttaattcctaggtattttattttatttgtagcaattggaaatgagattactttcttgatttctttttcagattgtttgctgttggcatatagacatgttactgatttttgtatgttgattttgtaccctgcatctttactgaatttgtttatctgttttaataggtttttgggggagtctttaggtatttccaatataagatcatagcatctttaaacaagcataatttgacttcttcctttccaatttcgatgccctttatttctttctcttgcctgactgctctagctaggacttccaatactatgctgaataacagcggtgaaagtggtcaaccttgttgtattccagatcttaaaggaaaggctttcagtttttccccatccagtacaatactagctatgggtctgtcatatatgaattttattatgttgaggactgttactttgatacccagttttttttagggtttttatcataaagggatgttgaattttatcaaatgcttttccagcattaattgaaatgatcatacagtttttgtccaccattgtgttatgatttatcacatggattgatttgcatctgttgaaccatccttgcatccctgggataaatcctagttggtcatgatgaatgatctttttaatatattgttgaattctgcttgcaagtattttgctgaggatttttgcattaatgttcatcagggatactggcctgtagttttctttctttgatgtatctttgtctggttttggtatcagggtaatactggcctcgcagaatgactttgaaaatattcctccctcctctatttttttgaatagtttgagtaagattggtattagttattatttaaatgtttagtaaaattcatcagtgaagccatcaggtccagggctttcctttgctgggagactttttataaataaaattctgtgataaaattttgttataattttgcatctctaaaataattttagatatattgaaaaatctttctataattttaattatgtaaaccttgaaagagataaaatgcaatctctgatttatctaagcattttcaacttactctaaaattaaatcttgaatgttttatttatgaaatccaataatacccagggatttgtagctgattgattgagggttttaacatctttaaaaataattgagcactactgacatgtcattttgtgaaataattattcttttcaaaatctacctaaaaatcacagcacagtttaatctacatataatggtctatattatcttgccatgacacaggattgttttaggtctcaggaaaactattctggtattaattttttatcagtctaagtcaatttgaggattatatatctaatgcaaatcataaatctgctctaatcttttagtttacaaaggtcatattcatttattgttttacctacaaaaatacactaagaccggatttactatggtgcaaacatcatttcaggttggaaacttatgcctttaaaattttttgtattttttgatatgaaaattatataatcataaaataaacttcatgaaatattgggaacactttgaacaagaagaaaatacaaaagtgaaactgataaacttaagtaaatagtttttcaatctacatactttccacatcccatagcaaactgaaatctatataatattctaatgtccagaatttagtacaatttggttaatgaaagcattcctctatgtaaaataatgggaaaacccattatcacaagttgaatttagcaataagatgtaatttattatgaatttctagttcttgtttaagatgtgagtttcagattgcttattataaactaattaaataaaagaatgccatagatgtaccaatactgacaatgtgtcaaggaatcaaagattataattaatgaattctatgtacctaacttttttttttcttttgagatggagtctcgctctgtcgcccaggctggagtgcagtggcgtgatcttggctcactgcaagctctgcctcccgagttcacgccattctcctgcctcagcctcccaagtagctgggactgcaggtgcccaccaacacgcccatctaattttgtgtgtgtgtgtgtatttttagtagagtcgggctttcaccatgttagccaggatggtcttgatctcctgacttcatgatccacccgcctcagcctcccaaagtactcggattacaggcatgagccaccgcgcttggcccctaaaatctttttttaaagaagataaaatatggggatggtttgatttgaaatacatttacaatgagaaattttaatacaaatgtttcctaatcagcaaatctaagacaaaaagaaaaaatgtagtgaatatcagaagaggatgcaatataaaaatatcattagatatcattcaaataatcatgaacaagtcataggacatgaaatagtcatttgaaaaatagcagaggaagaaagaagaggttaaagcctgacaaggtcaagagcagaaggcagaggaggaggtcttcaagggaagaccatggcaacttacccaggactaggaaaggttgaaggccctagaacaataagtgaacacggaatgcataatttatatatcatactcccttctcctaacacagctccctggaataaatgcaacagtctccacttatccatggtttcgctttcctctgtttcagttacctacactcgaatgcagtccaaaaataggtgagcacaatacaataagatattttgaaagaaagagggaaattactttcacacaatttttgttacattatattgttataattgttctattttattattagctattgctgttaatctcatactgtacctaactgataaactaaatttaatcatcagtgtgtatgtataggaaaagacagagcatatataggttttagtactatcagctgtttcaggcagcctctgggggtcttggaatgtattcctcaagattaagggggattgctatatttaatactgagtcagttcctcactgaatatagagtctactcagacaccttagggaaacaggcaacttacagaaagtaaaagccatagtttcttggtcccactccaaacctaccactcaaaagctaccaagtcatatttacctttacagacaatctcacacctactacgccttagagaatcttcccagtccccaaaattctccccaattgttctctagtgtcttaagttacatgaaaattctctaacttgagaaaaagactttcattccataattagaaataacaggccaggaattggagacaagatagcaacaaaactttattcacactggattttgttctgccaacaaataagcataaaaaaccaatagattattttctgctttgatagacagggccggagaacaggagaacactaggctcctcctgtctctggccctttccatagaaagaagaaaaatttgcaagaaaaatttccatagagaaaagaaaaagatgcaagaaaaaaggttgtagctaactttagagatccatgtgctataagttcatgacatgtgagacgaggcatcacaataagatctttccacagtttggcaggacattatcactgaatgtctatctacccttgaacaactcagtgtaaacagtcctatgtcaatggcaaaaattgttactagagaaattcagtttttcttccatgttgatagttcattggtttgactaaataatataaagaaaaaaattaatcttaagaatctaatcttcaaacataatcttacctgtcctatgaggtaattttagaacaaagggcttcatatcaaccacaaagtgatcaaattctgcatccagcttctcccatttttcttcttcacttcccacttccataatccaatctgtaaaagattttaaatcaaaatattaaggatttgtatgctgaaaactacaaaactctgatgagaaagataaaaaaaactcttaagtgttagatatcagttctccccaaattgacctgtagatttaatgcaactcccatcaaaacccagccgtattatttgtagagataagcttaattctaaaatttacatgaaaaagtaaaggaactaaagagcccaaacaattttgagaaagtacaaagttggagaactcacattaccagattttaagatgtactccaaagccacagtagtcaagacaattggtattggtgaaaggatagacagatcagtggaaaagattagagagtccagaaaccagaccaaaacaaacataaacaactgattttcaacaaaggtgtgatccatgaagaaatgacagttattacaacaaatgatgtcataacaattggatatccatatacaaaaaaaaaagaacttcaacctaaacttcatcctgtatataaaaattaactcaatatgaatcacagacctaagtgtaaaaatgtaaaactatacaactcttacaagaaagcatgggaggaaatctttgcaaacttgagtaaggctaagatttcttatatacaacattaaaagcactatccacaaaaggaaaaactgaccaggcatgatagctcatgcctgtaatcccagaactttgggagtcccaggcaggaggaatgcttgagctcaggagttaaagaccaccctgggcaatttggtgagaccccatctctacaaaacaaaaaaaaaattaaaaattagccaggtgtagtggcacgtacctgtagtcccagctacttgggatgctgaggtgggagaattgtttgaaagtgtgagaggtaaaggctgcagtgggccatgatcgcaccactaaactctagcctcggtgacagagcaagaccctatctcaaaaataaaaaagaaagctgacatattgaacttcacaaaaaaaaactgtcctgcaaaggacgttgttaaggaattgagaagataagccacagaccagaacaaaatatttgcaaatcatacatctcatacgagacttgtatcaagaatacataaggactctcaaaattcaacaatcagaaaacaaactaccccgataatcagcaaaaaaaattagtccctttaccaaagaagaaatacagatggcaagtaagcacatgacaagatgctcaatatcattacagaaatgcaaattaaaactatactgagataccactaacattaaaaatgcaaacaataccaagtgctggtgaggatggacaacaacagaaactctcatgcattgctggtagaaatacaaaatagtacaggcactctggaaaacagtttggcagtttcttacaaaaataaacatacactcagcctatgacccagaaatcccactcccaagtatttagctaagtgaaaagaaaaatctatatacacaaaaaaatccaaatgtgattttttttaaataaccaccaaacaactgaaaacagcccaaatgtccctcaaatggtgactagataaactgtggcatatccacacaataacatagtactcagcaacagaaaggaatgaactgctgatacacacaaaacatggaaacttcaaatccttatgctaagtgaaagaagcccttctcaaaaggctgcatactaattccatttgtgtgacattctagaaaaggcaaacaatataggcataaagaacagatcagcagctcatggggatagcagtgggggcagagtctcaacacaaagggatggcacaaagaaacgatttggcatgttggaatttttctgtacactatctatgtaggaagttataagaacctacagtggcaagaactatatgccaaaaaaagtgcatttgctgtatataagttaaaaaaaattttttttgagacagagtcttgctctgttctccaggctatggagtgcaatggcacaatcttggctcactgcaacctccgcctcctgggttcaagtgattctcctgcctcagactcctgagtagctgggattacaggcacacaccaccatgcccggctaacttttctatttttagtagagatggggtttcaccatgttggtcaggctggtctcgaactcctgacctcgtgatccatccacctcagcctcccaaagtgctggcattacaggcatgagccactgcgccccgccaaatttaaactttttaatcctttttaaaaactgtaaaatattggtcatcatacttccttctaattaacaagaaaaacactgaatacaaagggggtgaatcccaaaaatcaaaagtgtaggttttgacaaaatttgttaagttaaaaatacatacacacactacatgttcctttaaactgtgaaatgtcctgatagggatgtgcgctacctttacattatgaatagtgccaatttgtcatttattccatttacaaattctatattcggtgaaaagctttgttctgcctcataagctatcttgctccacaaactgccctctatctgctaaaccagcttctaatatttaccacattatcaaatggtttccatcatttcatcattaacaacctcttcatagaaagttctctctaccctgtctctgtaagtaaatcgtagcttttacttgctgactttactttcctcagtcattagaggtaagccaaggtctctcataatctctctcattctctctctctctctctctctccccacccgctctctcatgcatcctctgtagtctttcactttctccactcaaccatgcaatggaaggaaaacacttaccaagatccatcctgccacttcccaactactgctcttcctccctcagccccaaaatccctcatgaggctcaacgctccaaccatctgactaccatgtactcccctttctcatctctgtcatcttgcaaagaaacccgtctgaaactagcctcttgtcctcttttttcttttcgtttcgtttatttctttcgttttttgagacagaatctcactttgtaacccaggctggagtgtagtggcacgatctcggctcactgcaacctccacctcccgggttcaagggattctcctgcctcagcctcccgagtaggcacccgccaccacgcccagataatttttcgtatttttagtagagacggcgtttcaccgtgttagccaggctggtcttgatctcctgacctcgtgatccgcctgcctcggcctcccaaagtgctgggattacaggcatgagccaccatgcccagctgcctcttgtcctcttaaatgctctcttcttattccactagatctttcctttctacttggcaaggctgcaatcccttgatgccctccttcatgctctacagggttgctgggaaaaaatggcactgccttatagtcagatggcttccaacattacctgaaccctcaggagtcttgctatttcctactccacaaagcaactttaaaacttttcccaaatatcctacagccccttgaataactccagcttctcctaactctcaatttaaaaatcataaatcttgcttcagggaaaaaataatagtcaggtggtaccaccccaagatgttattcctcccacctctcaacttacctctcagagaaaacactcttccacctctgctcctgtatcagacgcagtaactctccctctacctgtcctctatcaattgcctatttgctatgtaaaattttccatctccactcactccttcccctctgatggcagctgagaaatatctcaaaatctgcctgcttctctattctcactgccacgatctcagatagaggcctgcccaccacttaacttgaactactgtggcagcctcatcatctgtctccctactgtcagttttctctacttgagtccattttcctcacctgttccagaatgagtttcctaatgacaaagctaagtctatcacttcctgtttaaaaatctcccctcattctagcattccattcgccaaatccacttactttctccacttcatcaacttctatccagatctcaccccctgtatattacctcttctatctccatcatggtagcaaaaatctttcaaagttcaccagtgatccactaattgccaaatccaaagggctgtcttcagtttgcatcctatttgacatctccacagcatcttccacttctgacaactccctgctcctaagaaactcttctttgacttcagtggttccattcactgctggctcccctactgcctcagatcattccttctcggtctctcaatggctctggcttctccagtcaatatggactctccagtgctctttccttagtctccttttgatctgacttttcacactcgcatagtgattgtattcagtaccatcgcttcaagtattcgtttcatgccattcacccttaaattttatttcaaactccagcctctctttgcaactccagactcatttacaatagctcctggacctattcactaatgtcctgtttattatctagatttatatgtccaagaaaacaatccttgatgtttttctccataaatctatgatgtactctgcttgatgacatcatcatctacttcatctcccaagctagaagtttcaatgttcccatcctctgaacccccataaaccaatacatcaataaatgctgagaaatatctcaaaatctgcctgcttccctattctcactgccacgatctcagatagaggcctgcctaccacttatttgaactactgcggcagcctcatcatctgtctccctactgtcagttttctctacttgagtccattttcctcacctgctccagaatgagtttcctaatgacaaagctaagcctatagcttcctgtttaaaaatctctcgtgactgcctaaaacagaatactatccaaacccaaagttaggcatacaagtacctttgcatttaggcctgtctctcacaccacacacacaaacacacacacacacacacacacacacacacacacacacactttgcctaactacaccaacccacaaatgcccacttccctcttgccacaatgaactcctcaccatggtcaaacccccccccacccccgagcccttatctaatcccacccccttttcataggctattccctccacctggagtcaggtaaatgcagctcaaatgtcacctgagtgaagctggcccccccttgccctagactggctgttgctctgttctcagtgtaaactgttcacatctgtgtacagcatttatcatgctgtttttttttttttttacacatctgtgtattattatgcatacatcttccattatctgtgagaagctcctagaaggcagggaccatgatttacacatcttagtaagtacctagcttattacctggtactcatcattttttgtttggttggttttgttttacatgtatacaatatattccatcagttatgcacgtggtaacagaaggctatgataccagtgctggatgtgagatcataatgttgaaaagcaacaattcaaatagatgaacaaaccaatggaaaatcataaacccagagttttaaagcacagctctggcctagatgtactccggggcttaaagactatatactgcccacgtactcaaacatttgcctgagaacatctatagctaaagcaaaataaaaaagattcctcctaatcactaattctcaataaatcctttgacatgggcaggaaatgttagtgtttaacattagaggaaactaaaattcaaccattaaatgactaactcaaaatcatgaaatcaagcacaaagctcagattaaaattctgaaacctctagccctcagatttattatattggccatttacatataagtgagcaatatctccaactaattaaaaagtattttgaaggccaggcgcgttggctcacacctgtaatcccagcacgttgggaagctgaggcaggcggataacttgaggtcaggagttcaagaccagcctggccaacatggtgaaaccccgtctctactaaaaataccaaaaaaattagctgggcaaagtggcacacacctgtattcccagctactagggaggctgaagcaggagaatcgcttgaacccgggaggcggagtttgcagtgagctgagatggtgccactgcactcaacctgtgtgacacagcaaaactctgtctcaaaaaaaaaaaaaaaagtattttgaaaagtagaaaggcaattggaattgctatattgacatgcaatattgaagtatacatttaaaaaaaaaactaaagaatcaaagtaacatttggtaaaaactaaaaatctgcttcttcttatcccttaatttttctccaaaaaaataaagaaatggaaaaagaaacaaaaaaactaacatttcaaaccttcaaggaattattgctatacaaattacatcttattggccaggtgtggtggctcacatctgtaatccaaacacttcgggaggccaaggtgagtggatcatttgatcccaggagttcaagaccagcctgggcaacatagtgagaccctgtctctacaaaaaaatacaaaaattagccaagcatggtagcatgcatctgtagtcccagctactcgggagactgaggtgggaggatcacttgagcccaagaggtcaaggctgcaatgagccaagatcacaccactgcactccagcctgagcaataaagtgagaccctgtctcaaaaaacctgaaaatggaacgggtgcagtggctcacacctgtaatcccagcactttgggaggccgaggcgggagggtcacctgaggtcaggagttcgagacaagcctggccaattaaaaacacaaaaattagccgggcatggtggcaggcacctgtaatcccagctactcaggaagctgaggcaggagaatcgcttgaacctgggaggcagaggttgcagtgagctgaaatcatgccactgcactccagcctgggtgacaagagcaaagctccgtctcaaaaaaaaaaaaattgaaaatgaaaaataaataatttaaaaacaaattacatcatattcacaaattgtatctaagttccaacttatcaaaagtttcataccatttatcagaattgaaaatttaaattactggaattgaaaaataagtaaagcaacatctttggcttaggcttagagtaattatagtgtgcctatcagttatataaattatttcaaaggtaacccaggtgacggacgttgcagtgagcgtgagctgagtttgcaccactgcactccagcctgggccacagagcaagactgtctcaaaaaaataaataattccaaaggtaaaaaagaagtaaattgggtgactcttgcttatagctacaatctatatttggatcatgtcttttattaaactcacccatgctgcctttttttaaacttctttttggacagctacaaaatgggcttacctaccctacagtcagcaaacataaccaaaccacaagtattaaaaggtctgggaaaaaaaggagtcacaactgccaagcaaagaatacacttcattcatatcacactccttgccaaacaaaacaaacgttcttggaagttgtgtaaaacccattttgttcaatcaaatcatattttaaatatattgtgggtcattaaagaaaactggaaacgtcgacaaattaaaaaggattagaggtgcacgttttctctggcttacacgtgtggatgttttgacaagagccttccctgactctacccgtagctcagtgtgtgctttagaaacaaatctcagtttattctctggcccggccctaccatttccgcaccatttccatggtcatttcacagaggaagaaggaagctgaggcttaagtgaggtgaagtcactgacctaggttcttagtggacagtgacagctgggcctgaacactgcacaaattattaataccatgcattccactaagctgcagcctgaccactgtggagaggctcatggaatttaatgtgccttttctatcttattttgactcatcttaaaatattaaaaacaaataaaagtagccgtgcaatgatcagaaaagctgttcacatttacttatgtcgttctcttgaacacttaaaaataattaactcagaaacacagggtagcatcctacatgcggcggtgctgggcttgggcctctccaagcggcctatgactttctgcaaaccaaccagcgccctggttctgtccccgcaaatccagctgattgttctgagactcttttctgggacggaattgaaaactccagcggtgccgttcctggcagtcccttcctcggcccgccgaggcccaggcccaggccgcgctcctaccttgtccaggacacagatttcctctcccagtcgcaaacccttgggtcagactcttggaccacgtcagaccgatcaaaccggctgatcaaactttacttagaactttcccaagtcgtcccggcctggatcgcgctctgcctgccggggacaccacagcgggcagcgccgggaccccaggggcgcgcgccccccaggcccggagaacgggcccagggcctgagggcgacgccccttcccgaacgggcccgcaagggcggggcggcagccaccggcgcaaaattccactcaagaacctggtgggaggggcgggggaaggaaattcagaaaaaaacgagaacctggcaccaccacacgcaagctttccgctcggccgctgccgccaacgccgccgccaccgccgcccctgccaaacggtttcaaatccttgcgggccgctgggtcgccgccgcccagcagcccgggggcggggactttcgcgctcgcatttccccgccccctactccacccctctagcctgcggtgcggttgccatggcgacgttcccggcggcggcgaccaccggcgccccaggctgggggcggagacttccgcgcgggcatttctccacccacaggtggcggcgtgcgcgcggccccgttgccatggcgacgctcctgctggcccagcaaccgccagactcgcaccccagcttgtgggccccttggcgggtccccagtcgaagcttccgggataacccgaccacagtttgaatgctgctgccctcccgcatcccgcgcagagtcgcttatgatcaccttaggggccgtggcgaaaaaataagggcacagaaaatggggcggctggaggatgttcacaaaaggggtgatccgttatgtggacagacatcagagttgaatgggtctcaagtgaaaatttcctcactctctgatatatcaaaacccaagtcaaattcttcaaaaggttctttttaaaacctatctcactggaagtaaacaccaacagctagctcttccttgtctcaaagacaaatcatgctaaggaaaataaagggtacagaatgcttttaagaatgtttagttttcaaaagcatacttgaacatgtttataactagggaatgatatataatccagataattagtactgagaatcaaggatgcaaaatcaagcatgcaattgcaggaatttaaccagtcagttaatacattcaagatagataaactggccgggcggggtggctcacgtctgtaatcccagtactttgggaggccaaggtgggcggatcaggaggtcaggagatcgagaccatccgggctaacacggtgaaaccctgtctctcctaaaaatacaaaaaattagccaggcgtggtggcacacggctgtaatcccagttactcgggaggctgaggcaggagaattgcttgaacccgggaagcaaaggttgcagtgagccgagattgcgctactgcactctagcctgggcgacagagcgagactcaaaaaaaaaaaaaaagataaactaccctactccagcctcaggaggaggaggacattggtcaaaggaaacaaaatttaagttagattggaggaataagtctaagcgatctattttacaacgtggtgaccatagtaaatgataatgtattgtgttcttgaaaattgctaaaagagtacatcttaagtgttctcatcacaaaattaataagtatgtgaagcaacgcttatgttaattagcttgacttagtcatttcacaatgttgtgcataataaatatatgcaatttttagaatcataaactgcattgctgaaagaatatgaaatgaatttgacaaatggtgtctaaataaacatgaaaagaaaaatagaagataaataaatagaagataaatcaaagaaaaaatgtaacaagctcaagctcatctcagaggaaataactatagcagaaaaatataactgaaaatgaaaaatgtctttaaatatttcctctacttaggtgaaaataagatgagtagatctcccttcccgcttttaagaacaagctgattgtcatttttttcatttatatatatcattttcatttatatatttttcattcatatatacacacacatgcaaataaaaatattaagatatgcatagagagttttattatttatgttatatgtatataacatgaaagggataccagcttgagcctgagctgtgttcaccttagaactcaagcctacatgtcatgtttagacgactggtaggcaagtttcacttggaaactccttacctgagaaccaaggaacctcctagaaattaagtcatcctggctgagcatggtggctcatgcctgtaatcccagcacttcgggaggctgaggcaggtggatcatgaggtcaggagttcaagaccagcctggccaatatggtgaaaccccgtctctactaaaaatacaaaaattagcaggtgtggtggcagacgcctgtgatcccagctactcaggaggctgaggcaggagaaccgcttgaacccaggaggtggaggttgcagtgagccaagatcacgccactgcactctagcctgggtaacagagtgagactctatctcgaaaaaaaaaagaaaaagtaagtcatcctaaagagatctggttcaatggcaatatgcaaaattgaaggggaaagtgatgatgcatgaagcaaagtgttggccgtgagttgcccttcatgtagcatcttcctctttgtataagagagtgattcctaatcttacagtgtaaagaacttcctttgagaattttcttttttctttttttagaggcagagcctggctctgtcacctaggctggagtgcagtggcatgatcatagctcactacagcctccaactcctgagctcaagcaatcctcccacctcagcctcccaagtagctcagtcagagacagagcactatgatagggtagttccatcatacacagagcacccatgtgactcaccctggggacctctacaaatatttgggaagaaattgctgaactcagagcctattcaggaacctcaaggatgaagccaggtaaatattctcttgtcggccaggcgtggtggctcacgcctgtaatcccagcactttgggaggccgaggcaggcggatcacgaggtcaggagatcgagacccgcctggctaacacggtgaaaccccatctctactaaaaatacaaaaaagaaaattagcaggcgtggtggtgggcgcctgtagtcccagctacttgggaggctgaggcaggagaatggcatgaacccgggaggcagagcttgcagtgagtcaagatcgtgccactgcactccagcctgggcgacatagcgagactctgtctcaaaaaaaaaaatatatatatatatatatatatattctcttgtcactgttgtagtgtagctccaggcttatgtggcctaaaaaatgcagtgtcttataaatgttttatggccaaacacctatggtaatcaatgaattttccttctacgtctagttactgcataaagataataatcttccaactcaatgtacatttattgaacatcaggtatatgcaggcatattaagggaatgtttcctccactggaaatgctatgacactttgctcttcaccttagcttaaatatcagtacctcagagaggccttcactgattctcaaaccagcccttatttcctttcaaatcccctggttctcttttcttcattgcatttatcaaaatttgtcatcaaatattaattagtggaatctatttatttatttatttatttatttgagacggagtctcgctctgtcgtccagactggagtgcagtggtgtgatctcagctcactgcaacttccacctcccgggttcaaacaattctactgcttcagccttcagagtagctgggattacaggcgcgtgccaccacacccagctaattttttatatttttggtagagatggggtttcaccatgttggccaggctgatcttgaactcctgacctcaagtgatccacccacctctgcctcctaaagtgttgggattacaggtgtgagccactgcacccaacccaggtgtaatcttttaaaaatgcctatagtttccaaaagaatgaagacgatacctgttaggttcaccattgcacagacagcaccttgcagggtacctaccatatagaaacaatccataaatgttcactgaatcaccaaatgaatgaacattaattttcgtgcttttctctgcacatgtggtagaatatgaccaccctatgcataaagcttccagtctagaaacccggaagactaacttttctgaatataaatctcttgctacggagagtgaaactgagtgatctaatttgaatcaggtaagcacaattagtccaatgagatatggccaggagatagggcatcctattgtataaacatgactttcttagctcatctttgcactttggggagagggtttggggttattttctcagaggactgaactgatgggtaaacccaaatggttctaactacaacaaagattctggacttatgagaaaaaagataagtctctaccctccaaaaatttatgagatagtaggaggtaataagacaaataccaaataaccacatttcaactcagattatgtcacctggcttaaaaggtatataaataatgcagctgggcgcgatggctcacgcctataatcccagcactttgggaggccgaggtgggcggatcacaagctcaggagttcgagaccagactgaccaacatggtgaaacccccatctctactaaaaatacaaaaattagccaggcttggtggtgggcacctgtaatcccagctactcaggaagctgaggcaggagaattgcttgaacccaggaggcagacattgcagtgagccaagatcgcaccaccgcactgcagcctgggtgacagagtgagactctgtctcaaaaaaaaaaaaaaaagatataaatcacgttttgggatagagaggaaataaagaaaacaccgtgctgtgcttataaagtcagcataggaaaatatatacagaaccttgttttatctttgataaaaagagagtgacattgaaacactatttctattgaaaatattgtttcctaacagctacaaatgacttaaatgaaagtaggtttgtttcaaaaacaaatgacatcttatctcaatttttaaaaatcaaatggtgacattgttgataatggtagtacaaagaggaccctaaaaataattgtttttattttctgtgtgggaagataactgtgctatacttcccatgttgaaagggatctgcttattttcaaaatataaacttaagaattagtctagatgacattgaacaatgtgaattcaattattctctacagaaaaaatcaataggaaaatgtgagcttttattaattagaaagataattattcgtctgtaatttgaactaatctgtatcttgaaggattaaatctgatgatctgtatagatatgtatgtgtgtatatatatatatatatatatttttttttttttttttttgagacagagttttgctcttgttgcccaggctggagtgcaatggcgtgcttactgcaaactccgcctcccagcttcaagcgattctcctacctcagcctccccagtagctggaattacaggcatgtgccaccacacccgactaattttttgtatttttagtagagacagggtttctccatgttggtcgggctggtctcgaactcccgacctcaggtgatccacccgccttggcctcccaaagtgctgggattacaggcatgagctaccgcacccggccaatctgtataatttaaactcttgctccataaaattaaagtaactatagtgggagacctagagattaccgttgtttgtttaagccactgttatttgggttttttgttttgctgagggaagaagagcctgggcctgatggagccccagggaaatcactaccgctgccggtgtttgcaggtagcagggagccaggcctgggcgaggtgtgtctcgatgccagagctggtagtacagaaggtggtgggccatccccggtgctgctcagcgtggtggatcatttcaaccgaatcggcaaggttggaatccagaaatgcgtcattggtctgttttgggggtcatggcaaaagaaagtacttgatgtattgaacagttttgcagttccttttgatgaagatgacaaagacaattctatgtggtttttagaccatgattatttggaaaacatgtatggaatgtttaagaaagtcaatgccagagaaagaatagttggctggtaccacacaggcctgaaaatacacaagaatggcattaccatcaatgaactcatgaaaagatactatcctaactcggtattgatcattattgacgtgaatccaaaggacctagggctgcccacagaagcatacatttcagtggaagaaatccaagatgatggaactccaaccttgaaaacatttgaacatgtgaccagtgaaattggagcagagtaagctgaggaagttggagttgaacacttgttacgagacatcaaagacacaacacaacggtgggcactctgtcccagcggatcacaaaccgggtccatggtttgaagggaccgaactccaagcttctggatatcaggagctacctggaaaaagtagccacaggcaagctgcgcatcaaccaccagatcatctacgagctgcaggacgtcttcaacctgctgccagatgttagcctgcaggagcctattaaagccttttacctgaggaccaatgaccagatggtggtagtgtacttggcctcactgatccattctgtgggcctcactgatccattctgtggtcgccctgcacaacctcatcaacaacaagattgccaaccaggatggagacaagaaagaagggcaggagaaaaaagagagcaaaaagatagaaaagctgacaaggggaaagataaagataaggaaaagagtgatgtaaagaaagagcagaaaaagtaaaacgtgtattaaatagcttttttatgcctgtaatcccaacattttaggaggccagggcgagtggatcacccaaggtcgggagctcgagaccagcctgaccaacatggagaaaccccgtctccactaaaaatacaaaattcgctgggcatggtggcacatgcctgtaatccagctacccaggaggctgaggccagagaatcgcttgaacctgggaggcatagtttgaagtgagccaagatcacaccattgcactccagcctgggcaacaagagcgaaactccgtctcaaaaagataaataaataaaattaaaaattaaaagtaaaaagttttcatggtttcaaagtttcatttcccttataaggaaattgaaaaatactggaaagtttaaagaagaaaagacttatgtgcaatcctgccattaagtaataactactattaacatttgtatatatttactcaaatttttatatctatattatcatttttaatatctacttattatgtcatcatatggatatgataattttctcaattactctcctgtgtttaccaattcttgcccttataaataatgttgcaatgaatgcctttgattatatacatcttggttgaaattttagctctctccataaaagatattcttatgggcattataaaagcattaaggcttttgatcagtactgccaaatcacttactggaagtatttttcaaattgcaacttcactcaatggtctgtgcgaatgactgtctcacattaatggttttttagatctgtgctaattgtgtgtaaaaaaaaaaagcatccctttttactttgcatttttcactattagagaagttgaaatatttaaatatctctattagtcttttattcttctgcaaagtatctcttttgtcctttatctatttttgtggaactttatatatagttatatggatatattagacagatataagtatcttccatatttttaatttattgtttcaaaattagcaatatgcataagctaacattcaaagcaatcaaatttccgtgattcaccattttgcattattaagatactccatcattagagtgaaaaatgtaaatgacttttagctatctagatggaaaacaatttgtaaataccaagaattgtaattattatataaacacattagagacaaatatgaaaacaatcctgtacctggtaaattccttaaactgaatggtaagtaatgcagaactttctatttacagaccacagaagtatagattataccacaaatgaatgcattataggccaggcacagcggctcacgcctgtaatcctaacactgtgggaggccgaggaaggcagattacttgagcccaggagtttcagaccagcctaagcaacatagcgagaccctgtctctatttttttaatagaataaataaataaatacagtataaagattgcagaaactaagaatgaggaggcatattttctttttttcactactaagaaaagagtcactgcctttagcacagtgactttggatttcttccttatgctagaactaagcaatattcaccatttcattcctccttctgctgctttttctatcttagcctcttgggcaattcatgctataggatattaacagagataaactggctactctttctcccttcccttcagtgatatacatattgccataatgccctagccagtatccataaaaactagcaacctaggatacttccaagccttgaatatacaacaatcttttctaccaacttgtttcaggagtaggctgtaaaactccaactttagaatgcaaatatttccaggaagctactgggaaaaatcatagcttaactagcagtataaaaatggtacgaaagaaatcattctgaagtttagatatctggttctgtcatttattagctttgtgacctcggtaaactaagttacataatcttcctgagcttcagtttatttattttccttatgggatgattggggagattgaattaacagaggtgagatatgtagaaaaatgtacccagtgcctgacacaggaaacttcaatatgagggcttcttttctttcccaactgttttgccagcactttggaaaggaatagatgccactaggaggcagcaatggcacacaaagaactaattatcatgtgcacgtgcatgcgcagacacacacacacacacacacacacactcacatgcatacgcatgggcacatacacaaagcacacacactcaaaccacatacacaaatccacatgcatgccacacataccacatatatactcacactcacacaaaagcaacaaatatttgcacagcaaccacatacacacccacacacaggcatactggcacacacatgcacacagctcaagttgttttctttccttttctttctttcttttatctttttaatcttttattgagagattaaagcagggaatgatcctcaggttaatagataggaaatgtcactgaggaatagtacttattattaagtttggggcacaggaaagagatcctatatattgaaagattggtccatgtattagaaacgagagaattatgttataaacttcttgcagaaatatagcataagagatacgtgaaaacattgattcctttgcatttagaacgccgtcctgccataaaccaagagaaaaaagacggtcattgagaagcaccttcagggaccaacttgtcttggaagaagacctccctagccatgtgcatttatagagtgtatagttatatagttatatgcatttgtagagttacagttatatagtatagagttcatttagtctatgattgctaggtgagtaatattactttgggaagattcagttcaactgtgcaaaaatagaggatgggcggggcgcagtggctcacgcctgtaatctcagcactttgggaggccgaggcgggcggatcgtgaggtcaggagatcaagaccatcctggctaacacggtgaaaccccgtctctactaaaaatacaaaaaattagctgggcgtggtggcgggcacctgtagtcccagctactcgggaggctgaggcaggagaatggcgtgaacccgggaggcggagcttgcagtgagccgagattgcgccactgcattccagcctgggagacagagcgagactccatctcaaaaaaa

SEQ ID NO: 248 - DNA, 57131 bp, Homo sapiens
ccgtatctacgaacccaaccaactacagaaaatatttggaaaaaaaaacaataaaaataataataaataataaaaataatacagattaaaaaacagtacaggccgagtgtgctggctcacgcctgtaatcccagaactctgggaggccgaggtgggtagattgcttgaggtcaggagttcgacaccagagtggccaacatggcgaagccccatctctactaaaaatacaaaaattggctgggcgtcgtggtgcatgcctgtagtcccagccacttgggaggctaaggcaagagaatcgcttgaactcagaaggcagaggttgcagtgggctgagatcacactactgcactccagcctgggcgacagagtgagactctgtctcaaaataaataaataaataaaaaatataaaacaatacagtaaatcaagtgcagtggcatgcatctgtaatcccagctattcaggaggttgagtcaggaggattgcttgagcccaggggtttgagtccagtctgagcaacacagcaagaccttgtctctaaaaaataaaaaataaaagaaaataaatacattttgaaatttaaaaaagtcaatacactggccaggcgaggtggctcacgcctataatcccagcactttgggaggccaaggcgggcagatcacctgaggtcaggagttcgagaccagcctggccaacatggtgaaaccccatctctactaaaaatacaaaaattagccaggtgtggtggtgggtgcctgtaatcccagctacttgggaggctgagcccagagaatcgcttgaacctgggaggcggaggtggcagtgagctgagattatgccactgcactccagcctgcgggacagagcaagactccctcttgaaaaaataaataaataaaaaaggaaaaggaagaaaaacaactgtttaaattgtattaggtattataagtaatctatagatgttttgaagtatacgggagggtgtgcataggtcatatgcaaataatatgccatttatgtaagggacttgagcatctatgccttttggtacccaggaattgcctggcaccaatccctagcagatactgagcaagggacaactgtatttccaattagggagataagtcaagattttacaaaagtggtagtatttgagttggctctcgtaagaattttgagtgaagatgcactgaaagggccaatccagataaaaggaagagtgtgaactgaagctggaaagtgcgtcctgtgttcaggagatgaccacatcaatttcttctaatagagacaaatggggtcagatagctgcagtctttgaatgccatactactgtctgaacttcattctctagtctgtggggagtcatcaaagtttataagcaggagtgtgacagacccggaattgaattttttggagacagagtctcgctctgtcacccaggctggagtgcaacagcgtgatctcagctcactgcaacctccacttcctgagttcaagcaattcgcctgcctcagcctcctgagtagctgggattacaggcatgtgccacatgtaaccacacccagctaatttttgtatttttactagagatggggctcatgcctgtaatcccaccactttgggaggctgaggcgggtggatcacgaggtcaggagttcaagaccagcctggacaaaaatcaccttttatagaatggattggaggcaagaacacccagttagaagcctatggtaatagaccaagtgaaaggtaataagacacatagtggaaataaataggaagatatatatgaagacaggctcaccatgacttgattttttaaaaattgcaggggctaaaagaaaggaaatagacaaaagataccgagccgagatgtttgggaagatattaatgtaattaacagagaaaatcacaagggagaaaaaagcaggtttgggagtacaggcataacttggagatattgcaggttcagttccagaccaccataataaagtgaatatcaccataaagcaaattgctcgaaattttcggtttcctggtacataaaaaaagctatgtgtttacacgatactgtagtctagtgcattatttctagtttgcattatttctttaaaaaaatttacatgccttaatttaaaatgctttttttttttgagacagagtcttgctctgtcacccaggctggagtgcagtggcgcgatctcagctcactgcagcctctgcctcctgggttcaagtgattctcctgcctcagcctcccgagcagctgggactacaggcgcccgccaccacgcccggctaattttttgtatttttagtagagatggggtttcactgtcttagccaggatggtctccatctcctgacctcgtgatccgcccgtctcagcctcctgcagtgctgggattacaggcgtgagccaccgcgactggccttaaaatactttattctaaaaatgctaatgatcgtctaagccaagtcataatattttcactgatggagggtctagccttgatgttgggggctgctgactgatcatggtgctgattgctaaaggctggggtggctgtggcaatttcttaaaataagacaacaatgaagttgttttcattcttcctttcatgatattgattgattcttcctttcatgaaagatttctctgtagcatgcaatgctgtttgatagcattttacccatagtagaacttctttcaaagttgaagtcaatcctcaaaccctgcaactgctttatcgactaagtttatggaatattctaaaccctttgttgtcattttggcaatgttcacagcatcttcaccaggagtagattccagctaaagaaaccactttctttacttattcataagaagcaactcttcatccatagtttcatcatgagattgcagcaattcagtcacatcttcaggttccacttttttttttttttgagacagaatcttgctctgttgcccaggctggactgcagtggcgcgatctgggctcactgcaacctctgcctcccgggttcaagcgattctcctgcctcagcctcccaaggctccacttctaattctagttctcttgctacttccacagcatctgcagttatttcgtccatgaagtcttgaaccccctcaaagacatccaagaggattggaattaacttcttccaaactcctgttattattgatattgacctcctcccataagtcacaaatgttctttttaaaatttttttattaaatatatttttacttttttttttttgagacacagtcttgctctgtcactcaggctggactgcagtggcacaatctcggctcactgcaaccttggtctcccaggctcaagcaatcctcccacctcagcctcccaagtagccaggtgcatgccaccactcctggctagtttttgtatttttttatagagacaaggttttctatgttgcccaggcttgtcatgcactcctgagcttaagtgatccacccacgttggccttccaaagtgctgggtttacaggtgtgagacatctcaccaagccaagtcacaaatgatcttaaggacatctagaatggtggtgagtcctttccagaaggttttcgatttactttgcccagatccaccagagaaatcactatgtctggcagctatagccttatgaaatatttttttttttttgaggcggagtttcactcttgttgcccaagctggagtgcaatggcacgatctcagttcactgaaacctccgcctcccaggttcaagtgattctcctgcctcagcctcctgagtagctgggattacaggcatgcgccatcatggccagctaattttgtatttctagtagaaacgggggtttctccatgttggccaggctggtctcgatctcctgacctggtgatccgcccacctcagcctcccaaagtgctgggattacagatgtgagccaccgtgcccggcctgaaatatatttcttaataagacctgaaagtcaaaatgactccttgatccatgagctgcagaatgtctgttgtgtttgcaagcatgaaagcaacattcatctgtttgcatacctccaccagagctcttgggtgaccagttgcattgtgagtgagaagtaatattttgaaagaaatcctttttttcctgagcagtaggacttaaaataaaacatacataaaacggtgaacttaaaatactcagttaaccatgctataaacatatatgctgtcatccaggttttgttgttccatttatagagcacaggcagactatatctaacataattcttaagggctctaggatttcagggatgtaaatgggcactggcttcaacttaaagtcaccagttgcattagcccctaacatgagagtcagtctgttcttagaagctgtgaagccaggtattgacttctctctagctacaaaagtactacttggcatctccttccaataaaaggctggttcatatatatcaaaagtctgtagtttagtttagccaccttaatcaattaccttagttagctcttctgaataacttgctgcggcatctacatcagcacttgctgcttccaccttgcacttttaagtaacggaaatagctcctttccttaaacctcacgaaccagcctccgctatcttccaccttttcttctgcagcttcctcacctgtctcagccttcattttattgaagagttaggactttgctccagattaggctttggcttcagggaatgctgtggctggtttgatcttctatccagaccactcaaactttctctatatcagcaatgtctgtttcactttcttatcatttttgtgtttactggagtagcacttttaatttccttcaaaaacttttcctttgcatgcacaacttggctaactttggtgcaagaagactggctttcatcctgtcttggctttcaacatgcctttttcactgagcttaatcattttcagctttttatttaaagtaagagatgtgtgactcttcctttcacttgaacccccactgtaggattgttaattggtctaatttcaatattgttgtatcacaggaataaggaggcaagaagagagggagaaaggcagggagactgctggtctgtggagcagttaaaacatccacaacatttatgaattaagtttgccatcttatatgggcatggttcatggtgcccctaaacaattataatagtaatataaaggataacagatcagcataacatatacaataattatgaaaaagtttgaaatattgtgaaaattaccaaatgtggtgcagagacacatagtaagcctgtgctgtaggaaaaatggcgcagatagatttggttccatgcagagttgccacaaaccttacatttgtaaaaacagttacctgggaagcgcaataaaggaaagtgcgagcctgtagcagatgcacgttccatttagacatccttaggactcacaccagcgaagggccccagcttttccataccagtagctgtaattctgagacgaaagtgcttttcccccacctttacaccttgctttctggaaagataagaccataatggattttgaacttgcttttatcattaaagcccagtgtcttacatttctccggaaaaggaagcagtgtttgctatggaacaaatagtagaattttaatacatagtcccctgaccgtagaaactgaacctcaggtcctatcctggctctaggccacccggtcatggaagaagaaacttttcttagaatctttatctcttgagacaagcttggaaattacaacatatatgtaccatgaacgcgaagtacctgagctcaaagcagttgagcaatcttaagtgggggtgcccgaaagtggtgcgttctgaccccaaacgtcacactacccgtccctggaggagcgggttgcagcccagctgcgtcgccccgcgcagagctccaggcagaagaaaactacatttcccagagacctctgcgcggtcgggagcaccgcgaggaggggcgagatgggggcgggcctctgtgtgaaggcccttcccattggtgcgcattccaaagggccatgtaaacttcttcgcgattgcacggattcagggacgctcagtggcgccgcgccgctccttggtttgacttttgtttttcagttgcgttccctgactcggagtcttagtgtgtcgtgagtatagagtttcgggtttggggtgaaggggttaggtaagaagccttgggaagaaaatctggttagggagaagtaactgcggaagcagtgcggaggagaggacgtgagcctgaatgtggtgtccgtggaggggctggggaccggaggaggaaagctccaatgtgcaaagggagagacctcaggagtgctggagcgttgggacctggagcagtgaggcggtcgagaatgggatgaagtgggaaaaggagtacgggattcgggcgccctggagatgcgttccggtgtactctaaccccacgctggtctagctctcagtttcctcatttgtgaaataagggatagtgaaaatactgaacggttgttgggataataaattgtacagatttgtcacgtggctaaaagaaaaaaattcaaagtgctacacaaatgttaattgttagtagacaagctataagaatatatctaagcaagggtattggagataggtgcagagaccctagctgaaacccgttaatttacctataaacaaaggcattgttcctttggaagaggcaatgaagagtaagacgcgatttctgtctgtagggagcgcacgctagcatgggagaaacgatagcaataaagcactctaatatgttgacttgtagataatttcaaaggcagttcttttgcacttagatcatttttgctaaatcattttggatggggagactcaggaaagagaaaaaggaggtggtatttaagatgagttttcatgtacagactagattttgttaagtgaaattatgagggttgtggagggagttgtgttccagctagagggaagctcatgaacaaaggtatggaggcaggaaagttatctggaaacggtacatttaggagagtagagagaaataaggcaggaaagttaggtttggcccttatgtagaaagccatgaattctaggctaacaaattggatttaatgctttaggctatgaggtgctactgatgtattttattaaagaaaatggtccaggagacgcaaggagtaggtagaaccgttaaggtgttgtaatggtgtgggtaagaagtattgagactctgaattaacatggtcattgtggagataaaatatacaagatattcatatggttagacaggaggttcagaagaatgagtgatcaaatgatgaatttaagttgccaactcccggttgcttggaaacgctgaattagtaactaaaataggaaagtcagaaggggcatgtttggataaaaagatgatgtgttaggtttaggaaatgttagctttgagatgctaaaaaaatacctaacttgagtgatttcttttttaagttaaacgtttcaagtgccagtgggactatgggtgaaaatgtccactacatttttgttaattcaaatcaagaggttgaaagagatgtcgtttatttattcaacatgtaattgttacttactgtatgccatgtagtgttttagatgacagagttaataataaaaacaggaggaataatgatgttcccaaagaaatggttagaggaaatgataaagaaacttgaagacagaacctctgagccaagggagtaaaattgtcaataataataatagtccacatttactgagtgcttatatatgtgtcaaacactgtccctcggccttatatccgtacaccaacctatgacatagaagtaactgaaatttagagaggataacttgcctgaggtacacagctaataagaggcagggctttgactcaaacccaagtctgatatcagagcccacattctcaactacaaagcaatatttatttttattattattttttccaggtaaggtctcactctgtcacctaggctggagagcagtggggcaatctcagctcagtgcagcctctgcctcccaagctcaagcaatcctctgcctcagcctcctgaatagctgggactacaggcacgtgccaccactcccagctaattctgtaatttttgtagagacagggtttcaccatgttgcccaggctggtctcaaactcctgacctccagcagtccattcaccttggcctcccaaagtgctggcattacaggcatgagccactgtgcccagcctattttaattgttttttgagacagggtcttgcgctgttgtccaggctagagtgcagtggcacgatcactgctcgctgcagccttgaaccctcaggctgaagtgatcctcgcaccaagcaggtgggactacattgccactgtgcccagctaatttttaaaattttggtaaagacagggtcttgccatggcctggccatgccaaggtccggtcccaaagtgatatatttttaaagggtagttggcactaccaggcacagtggctcacgcctgtaatcccaacactggcaggcagaggtgggtggatcatctgaggtcaggagttcgagaccagcctggccaacatggcgaaaccctgtctttactaaaaatacaaaaaaaattagccacagtggcaggtgcctgtaatcccagccactggggaggctgaggcaggagaatcacttgaacccaggaggtggaggttgcagtgagccaagatcgtgccactgcactccagcctgggctgaacagagtgagactctgtctcaaaaaataaataaataaataggtagttggcactatctaattaagaatacaagtgaaggagtaactattggatggaggaggatagaaacagaaaagagcaattgaatttattaatttggatgtctgctgaccaataagagcttggttagatgtcatagtagaagcccgaggcctggctcagtggctcatgcctgtaatctcagcactttggaaggccaagggaggaggattgtttgagtccgggagttcaaggccagcctgggcaacatagcaaggccccgtcttgcagccagagaggtgagtgtagacaacttttcgtagacatgtgcaacagtgaggacagtcactatgaaggagaagagggattgcaggttgttagaagggtctttcaaagcttcaaattacttttttttttttttttttgagacggagtttcgctcttgttgcccaggctggagtgtaatggcgcgatcttggctcaccacaacctccgcctcccaggttcaagcaattctcctgcctcagtctcctgagtaggtgggattatagggatgcaccaccatgcccagctaactttgtatttttagtagagatggggtttctccaggttggtcaggctggtcttgaattcctgacctcaggtgatccgccttcctcggcctcccaaagtgctgggattacaggcaggagccactgtgcccagccgcttcaaattactcttaaatggctttgaaacagtgaaatttaactttaagttgtcacccatatccgtacaatggaattttattcagccacaaaaaggaatgaagtactgatacatggtaccacataggtgaaccttgaaaacattatgctaagtgaaacaagacagtcacaaaagaccatatactatgtgattccatttataggaaagtccagaatagggaaatctgtagagacagtaggttagtggttgcttaggactgggagacagggataatagctgaaggacacagggtttttttcttgaagtgacgaaacttctagaatggactgtgctgataggtacacgtatctgtgaatatactaaaaatcattgaatttacactttgaatgagtttaatggtgtacacaaattacattccataaagctgcttttttaaaaaaatgttacccataatccttccatgccaatccaataactttattttctaggttatttggacaagaggcacattgacccaatttggagacgtattttggaaggaggtgagtttggaggaggagagtagtcttttaaaggagagaattagaagaaagatggcgtatttgaagggttggctgtagaagaaaacaaatgggatgagagaagcagaaacagatttttaaatctagattgaatagactggccagcagaagaaaaggatgtttaacagtctttcaaattcatattgagagttgtatatatatacatatacacttagtatgagccaggcactgtttatgttactagggatacagcagtgaacataatagataaaaacccgctgcctttagtgagtttgcatattccagtgtggagagacagacattaaatattagatggttataagtgttcaacttttttttttttttttttttaagagagggtctcactctgtcaccccagctggactgcaatggcgtgatcatggctcactgcagccttgatcccccggtgcaggcgatcctcctacctcggcctcctgtttaactaggactacagacatgtgccaccacatctggctaattttttgtagagacagggttttgccatgttgcccaggctggtctcaaactcctggactcaagcagtctatccgccttggcctcccaaagtgctgagattacaggcgtgagccacttcaactagccaaggttgtaagtgttaatggagaaaagtaaaacagagaagagggatgaggttggtagagtggtcagggaagacttcatcaagaaagtgacattttagccctgaaggaggagagggagtaagccacatagataaatggggaaagaacatcatagcaaagagaactgtaggtacggggactctgaagtagaagtgtgcctggcacgtttgaagaacagccaagaggccggtgtttttaccgcagtgaacaaggataagagtagtaggtgaggtcacagaagtaatgaggttggccagatcatacaggaccttgtcggcaattttaaagaccttgaccctctgagtaagatgaaaagtcattggaggcttttgggcagaggagttttgtgttttgacacatatatattaatgtgttgagaatacattataagggatgaggttgaaaatggaacagggggaccaggcgtggtgactcatgcctgtaatcccagcactttgggaggccaaggcaggtggatcacctgaggtcaggagttcaagaccagcctggccaacatggtgaaaccccgtctctactaaaaatacaaaaattagccaggcttggtggtatgtgcctgtcttcccagccactcgggaggctgagacaggagaatcacttgaatcctggaggcagaggttgcagtgagccgagattgcgccatcgcactccagcttggatgacacagcaagactttgtctcacacacacaaaagtggaacgaggagaccagttaagagaccgttgtcgtcatctgggcaacagatagcagtgggttggaagccaagcgcagtgactcatgcctataatcctattacttgtgtggctgaggggagaggattgagtgaagccaggagtttgagacaagcctaggcagcaaagcaagaccctgtatctaaaacaacaaaagcaaaaacagtggactggaccagggcaatgagggcataggtgataagtagttgtcagattctagatatttggatgagctagccagtaggatttgctaatgggtcgtgtgtggcatgtaagacaaagagaggagtaaaatttcttaaaccaagtttgtctgtttgtcataaacaactggcagcatagaattagtatttattggaatgtagaattctgagagaagagcaggtttttgtggtgggaggtatgtatcaggagctcagttttatatttggcgagcttgggagacctgctggacatccccatggagagacggggtaggcagttagatgtgtgagtctagagtggagggcagagtaaggactgaggcatcaatttgaaaactactaatgtgcacatgctatttaaaactgtgagacttcaggagatcaccaaggcaatgagtaatgaccagtaagaaaaggggacaaccaggaagaggtgtcctggaagccaaacaaagaaagctttgacggagtcagggagagaggcactgtggggttctgagcaggaaaatggtatatggaagtaacagtggtgattatctcttttcatacttttacacaaaattctttcccaaaggactgaagatttttttttttttttttttttttgagacggagtctcgctctgttgcccaggctggagtgcaatggcgcaatctcggctcactgcgacctccacctcccaggttcacgccactctcctgcctcagcctcccgagtagctgggactacgggtgcctgccacgacacccggctaattttttgcatttttagtagagatggggtttcaccgtgttagccaggatggtctcaatctcctgaccttgtgatacacccacctcggcctcccaaagtgctgggattacaggcatgagccaccgcacccggccacaggactgaagattttaaatagattataccaggtagaaggacataacagaacatcatctgacttgctcagaatcagagtggattgacagcgaatgcttgataagaaagttttcaccaaagcaataaaaaaatcagcctctctccctctctccttctgtctctgtcaatcatataacatggtatggcattccctttccagccatgaggtttatcttcatgaaaatttctataataaggttgcttaaagtacaggagctcaagatcttgggttatcaattgagatggagattatgaagagccttttaaagtttataagtaattttttttcttttgcttaagataatagagaaagtacgcgaaataaagatagcatcagtggctttatattcattttaaatttgatatagtgggtactctgccttaatttctatttactacttctgcttttggagaggggagtgggggcaggggaagtcaatatgttggtgaggctggccttgaactcctgggctcaagggatcctccctcctcagcctcctgagtagcagggactataggtacgggccactgcacctcgctctatgtactgtttcttgcttattagagacttttctgcatcttctcctcctatcctataacttcaaggaaaagattgtagatttgtttttgtgttgttgcagataacaaggagacttttctactttgtgtgcttatccatttaaatattcaatgccattctgatttttatttgaaaataattatgaggagtaccttttgaaaattcaaaaggcatgaatttcaggatttggagatactttaaagaatactacattttaggccgggcgtggtggctcacgcctgtaatcccagcactttgggaggccgaggcaggtggatcacaaggtcaggagttcgagaccagcctggccaatatggtgaaaccctgtctctactaaaaataacaaaaattcgccaggcgtagtggtgcacacctgtagtcccagctacttggaaggctgaggcaggagaatcgcttgaacccagaaggcagaggttgcagtgagccgagatcacaccactgcactccagctccagcctgggcaacagagtgagacactgtctcaaaaaaaaaaaaaagaaaaaaaaaactacattttaaaacatcagattctttccaagaagcaaatatgatgatgttgaagagggaaccagtctaatcctgtactgtttttatttttctattcgtggcccgtaattatgaatttttgtgtatttgataggtgtgaaaaagacagcatgaactttaccccaacacacacccctgtctgcagaaagtaagacatttgcttattttcaagttgttaagaaatcgagacttgtatagccttagtctaagcataggaactggaaaggtattggaaacatatttcctaaagttttttttctttgagacagagtttcactctgtgcccaggatggggtgcagtggtgcaatcattgctcattgcagccttgacctcctgcactcaagcaatcctcccacctcagcctcccagagtgctgtgattacaggcataagccactgtgcccagcctgagacatcccctttagaaaatatgaaatgttggccgggcacggtggctcactcctgtaatcccagcactttgggaggctgaggtgggcaggtcacaaggtcaggcgtttgagaccagcctggccaacatggtgaaactccgtctctactaaaaaaaaaaaaaaaaattaactgggcatggtggtgtgcacctgtaatctcagctacttgggaggcggaggcaggagaattgcttgaacccagttggtggaggttgcagtgagctcagatcacgccactgcactccagcctgggcaacagagcaagactccatctcaaaaaaaaaaaaaaagaaatgttaagtaaactagtatttctctcacaagtttttaatcactgggaaaatgtttaagtttttcttcatgctagttgacagattttaatatctctgcatgcttatttattacaagtgagcacatatattaactataactcagagcttctggtatagtttctccactgtactattttgttatgttataaattgcagacaaccaaattggatttattttcacaggagggtttctcttcttctgtactatttttgttttttttttgttttttgagatggagttttgctcttgttgcccaggctggagtgcaatggcatgatcttggctcaccgcaacgtctgcctcccagattcaagtgattctcctgcctcagcctcccgagtagctgggattacacacgcgtgccaccaggcccggctgatttttgtattttcggtagagactaggttttgctgtgttggccaggttggtcttgaactcctgacctcaagtaatctgcccaccttggcctcccaaagtggtgggattacaggctaatttttgtatttttggtagaaactaggttccgctatgttggccaggctggtctggagtggcgtgatctcggcacttgaacctgcctcctgcgttcaagcaattattctgcctcagcctccagagtagctgggattacacacgcgtgccaccaggcccggctaatttttgtatttttggtagagactaggtttcactatgttggccaggctggtcttgaactcctgacctcaactaatttgcccgccttggcctcccaaagtggtcggattacaggcatgagccactgcacccggcctgcaatatgtcttatggtactacattttctaattgttactacatggtctcccttagtttatattctgtttttttaaattatctttttcgtctctaatggattttatttttactttagagacaaggtgttgctatgttgcccaggctggactggaactcctaggctcaagcgatcctcccacctcagccccctgagtagctgggactgctcagctactcagctgtgccaccattcctggctctaacatgtattttgaatccagctttaaaccattagtacttggaagataattaataaaattatttactatcctgtaatatcaaactttcaatttgttttttttttttgagatagagtctcgctctgtcgccaggctggagtgcaatggcatgatctcgactcactgcaacctctgcctcccaggttcaagcgattctcctgcctcagcctcccgagtagctggaactacaggcgtgcactgccacacccatctcattttttatttttgtattttggtagagacggggtttcaccatgttgcccaggctggtctcgaactcctgagctcaggcaatctgcctgctttggcctcccaaagtgctaggattacaggtgtgagccaccacgcccggccaagatttttttttttttaaataaagacagggtttcactatattgcccaggctggtcttgaacccctgagctcaagtgattctcccaccttggcctccaaaagtgctgggattacaggcatgagccactatgcctgtccaaacttccaaatttatgagcaccttaattataagcactttgggaacacaaaacccccttttatttaggaagttataactcataaactttcgcagagtgtgatgaatatatcatttctaatttcacgtaggcgaacagttgtctccaaacgtggtgttgccgtcagtggtcccaccaagaggaggggaatggcagattcactggagtcaacccccttgccttcccccgaagatcgtctggccaaactccatccttctaaggagctcctggaatattatcaaaagaagatggctgagtgtgaggcagaaaatgaggacttgctgaagaaactggaactctacaaagaagcttgtgaaggacaggtaaagaaacgatgctgctgctttagaactctgatggagtcttcataaattagagatgccctacaagtgccagtttatatcagaagcagatgttttataaaaatactccttttttattccccagcccagctattgccccttcaggccctccttggatcataacccccaaaactgcccttcctctcaaatcttaaattctgacatctccatatctcttatacctagttctttcatctccttgtacctgagtagtccttaacttctttgttacctccatagcttcctgacttttcagttttctgagtgctgtatatagctctgatatcaagtccttcaaacctaaaccccatgatgctttacttgagtagtaactgcagtgcctgcaaatgaccccttgctcaattattcttctgctccacctgcatagcaaaaactgagctgtggcatcatccagttctctgccacgtgttctcctatagcaggatttcttaacctcggcattattgacattttggcctggatgattctttgttgtgaggggttgtcctgtgcgtgatgggatgtttagcaggatccctggcctctacccgctggatgccagtaacacaacacccccagctgtgacaatcaagaatctctccagacattgccagatgtttctggaatgggtgtatggatgtgcagagtcactcctgattgagaacactgttgtagaaaggtcacaaatcagtacagaatgaatcgatggtaaacaaattcagctgtaccctcaaccattatacagcagtcttctcacctatccttactggctttcctctccttccacatctgtgccataccctcacctctagcctgcaaccccttcttagccctcctctctcaacatcttttctgccatctgcacaccgttactccatccgtatctatctccttcttccttcctttgttttttctctggttgcttttctttttttttttgagacggagtctcgctctgtcgcccaggctggagtgcagtggcgcgatctcagctcaccacaagctccgcctcccgggttcatgccattctcctgcctcagcctcccgagtagctgggactgcaggcgcccgcaaccatgcctggctaattttttgtacttttagtagagacggggtttcaccgtgttagccaggatggtctcaatctcctgacctcgtgatctgcccacctcggcctcccaaagtgctgggattacaggagtgagcaaccgtgcccggcctgtttttttgtttttttgagacagcgtcttactctgtcgcccaggctggagtgcagtggcgcgatctcagctcactgcaagctccgcctcccgggttcacgccattctcctgcctcagcctcccgagtagctgggactactggtgcctgccaccatgcccagctaatttttttgtatttttttagtagagacagggtttcaccgtgttagccaggatggtctcgatcgcctgacctcgtgatccacccgcctcggcctcctaaagtgctgggatttcaggcatgagccactgcgcccggcctctctagctactctttttatataaatggctctttcttttcccagtcacacttccagaatcttttgactttcccattcactgaatgggatttttttttttttttttttgagacggagtctcgctctgtcgcccaggctggagtgcagtgacgcaacctcagctcactgcaagctctgcctcctgggttcaagcaattctcctgcctcagcctcccgagtagctgggattacaggtgcacgccaccacacctggctaattttttgtattttagtagaggcagggtttcactgtgttgcccaggctggtctcaaacacctgagttcaggcaacctgcctgcctcggccttccaaagtgctgggattacaggcgtgagccaccgcgcccagctgggaaatgtcttgactgcagtttcatctcggtccttgccatgccactaaaaccgtgccgtctgcggtctccaaatacctgtttaccaaacttttctctttttgccctttgcagtgtctgtcacttttgacctctctttttctaaaattttcttcctttcttgatttccttttttttttttttgagacggagtctcaccctgtctgccaggctggagtgcaatggcacaatctcggctcactgcaacccctgtctcccgggttcaaacgattctcctacctcagcctcccaaatagctgggattataggtgcccaccaccacacctaactaatttttgtatttttagtagaggtgggttttcaccatgttggccaagctcatctcaaactcctgaccttgtgatccgcttgccttggcctcctgaagtgctgggattacaggcgtgagcctggcctcctttcttgatttctgtgtcatttttctttcacaatttctatctaacctctctgatcagctcatctcagtgtccattaacaactctctttccttactcttaaatttcagagttcttccagattctactataaatgaccttgttttatccttgtattacacttctgcatacgggatgatgactgttaaataactaaccctgactcacttttctcctgaggctcctttctctaccctcccttccccacccgcacatgtactgccaccatttcgccttcctccgtttctcatgccttaactttttctttattctttgtcttggcaaatggcatcattgcctacggttcttccagtccccctaaaccgaatcatttggcaagtcctgttgattctgcttcctaaatattacttaatccattcccacacccacctcactttggccacgatgctcacacagacccttgagttgcgtctaaactgtgacggtgtcctccttgccagtacctgcctctggcctcttacatccccagttggcctcacacttttcactctagcagtactgaaatatttgtacttgtccaaatttaataggcttttgttttttggaggtttacttgtcatttttatcacattatgtatgtatacaatgaattacagggtaattcattccatttgggctcctggatagcttcaggatgggagctggttgccagatggcagtgatgcagcatctctgaatacatttactgggacacagtgtgagccaccgtgcccagcctaattgtttttgtagattctacaaaaaaagtgtttccaaccttttgagttccactgtggacttgtatgctctccctttctctgaatcagttgttaatatttattaacataattattaacataatattatgttaatataatcaacataatattatgttaatataatcaacataatattatgttaatataatcaacataatattatgttaatataatcaacataatattatgttaatataatcaacataatatgttgatattattaacataattaacataataatatgttaatattaacataattattaacataataatatgttgatattattaacataattattaacataatatgttaatattaacataattattaacataataatatgttgatattattaacataataatatgttaataaaaatgtaataaatatttttatcacattatgtatgtatctatagacctctgggttttttgttttttgttttttgagttagggtcttgccctgttgcccaggctggagtgcagtggtgcgatcatagctcactgcagcctcaacgtcctggactcaagcaatccgcctgcctcagcctcccaagtagctgggactacaggcatgtatcaccatgcccagctaattttttattttttattttattttgagatgaagtcttgctcttgtcacccaggctggagtgcagtggcacaatctcggctcactacaacctccgcctcccaggttcaagcaattctcctgcctcagcctcctgagtagctgggattataggcgcccaccaccatgcccggctaatttttgtacttttagtagggactggatttcaccatgttggccagggtggtcttgaacgcctgaccacagatgacccatctggctcggcctcccaaggtgctgagattacaggtgtgagccactgcaccctgcccaattttttattttttgtaaagacagaatctcgctctgttgtctaggatggtcttgaactcctgggctcaagccatcctcccactttaacctcccaaagtgttgggattacgggcgtgagtcactgtgcccagcctttatgaaattatttttaatgaccttgcccaattttaagtgttcagttgagtagtgttaagtgtttatgtgtgtgtgtgtgtgtgagtctgtgggtgtgtgggggtgtgtgtgtgtgtgtgtgtgtgtgtgtgtgtgtatatatatatatatatatatatatatatatatatatatttcttttttttttttttggaggcagtctggctctttcacccaggctagagtgcagtggtgccatctcagctccctgcaacctccgcttcctgggtttaagcaattgtcctgcctcagcctcccaagtagctgggattatagggtgcgccaccacactcagctgatttttgtttttttggtagagatggggttttgccatgttggtcaggctggtcttgaactcgtggcctcaagtgatctgccacgcctggcgtgttaagtatattcacattgttgtgtgactgatctctagaacgttttcattttacaaaaccaaaactccatcccattaaacagatcatttctccccacactccctgtaaccactattttacttgctatttctatgaattagaaatagagcaggatttgtcaggcatggtggctcgtgcctgtaatcccagcactttgggaggccgaggccggcggatcacctggggtcaggagttcgaggccggcggatcacctggggtcaggagttcgagaccagcctgaccaacatggcaaaacctgtctctattaaaaatacaaaaattagctaggcgtggtggcacatacctgtagtcccagctacttaggaggctgaggcagaagaatcgccaaggaggtggaggttgcagtgagctgagatcacaccactgcattccagcctggacgacagagcaaggctctgtctcaaaaaaaaaaaaaaaatagagcaggatttatttagaatagagtggaatcatactgtagtttttctttttgtaactgacttatttcacttagcataatgtcctcaagtttcgtctgtgttgtagcatgtgatgagattgtcttcctttctgacaacatcaggctctctcatggttcttatttacagttctcttttcttggagtaccaactgtctgcttctctctctacccatcttctgttcatctgtcaagtgtcagctcttgggtggtagcgctttgatttcccaaacagatctcagaatgtttattcctgccacgctttcccccacaccatttcaccatgcatgctttcatgaagtaattattttattttaatcatttgcctctctccccatgaaattccgtagctctgtagacaggaatcgtatcttttcatctttgttttcctgcatgtcataataatgcttatgatataggaaacattactaaaaaagtgtggataggctaggtgtggtggctcacgcctgtaatcccagcactttgggaggccaaggtgggtggattgcctgagctcaggagttcaagccagcctggccaaaatggtgaaaccccgtctctactaaaattagctgggcgtggtgcacacctgtaatcccagctactcaggaggctgagacagaagaatcacttgaacctgggaggtggaggttgcagtgagctaagatcatgccaccgcattccagcctgggcgacagagtgagactctgtctcaaaaaaaaaaagtgtggatagaataggtgagtcgtacagcattctggattctatagtctgtaaaaggaagatgtgagagctttgatgttaaatgcaaacttcacactcatcctgtagctgttaaactccagtcaaggctgggcatggtggctcgtgcctataatcccagtactttgggagactgaggcgggtggatcacttgaggtcaggagtttgagactagcctgcccaacatggcgaaaccccatctctactaaaaatacaaaaattagccgggcatggtggcatgcacctgtaatctcagctactcgggaggctgaggcacaagaatcacctagaaggtggaggttgcagtgagctgagatcgtgccactgcactacagcctgggcaacagagcaagacttggtctcaataaataaaaaaacaaacaaactccagtctatacatgcctattgctgtcatttgaattctgtattggcaaaattatttactttggaatatttctacatgagtagactcctccctatccagtgagagatactccattgaaacccagtgtctttcaactatcttattgtggtttttttgcagcataaacttgaatgtgatttgcagcagagggaggaagagattgctgaattgcagaaagctctaagtgatatgcaggtctgcctcttccaggaacgggaacatgttttacgcctctactcagaaaatgaccgactgagaatcaggtaccaaataggagaagggaaatgttggagtttaactttaaattacattcattcattcattcattcattcattcattgatttagaggcagtatcactctattgcccaggctggagtacagtggcgctctcttggctcactgcagcctccacctcctggttccagcgattctcatgcctcagcctctcgagtagctgggaacacaggtgtgcactacaaggcctagctcatttttgtatttttagtggagatggggttttgccctgtcagccacgctggtctcgaactcttggcctcaagtgatccgcccacctcagcctcccgaagtgttgggattacaagcgtgaaccaccatgcccagccctttaaattacttttaaaaagatacatttctccacattaattctcttaggttgtattctctaggaagtggactctgagatggagatttgccttcacggtagttactggagaagctctctggaataatagctatgagcagatttgggcagaggtagaatatgaacggatactgtggtaacagaagccttaaccaacccccatagggagcactaaggatagggtggtctttcggcagcaaaggactgagaattttgtgtccccacattgaccagtcataggatgcaggtagtccccagggagggtatgtaaacttgggagaagaagcccccttcagccaagtgtcatttttcagagaaaaactgagctcctgggagatatggtcacaagaaggagtcatagcagtacactacatgttccattacagtgctcttctgtgtgtgtgtgctgggagtgagagggtaaaatacacatagcagcacactccatgttccattacagtgcacttctgtgtgtgtgtgctgggagtgagagggtaaacacacatagcagcaccctccatgctccattacagtgctcttctgtgtgtgtgtgctgggagtgagagggtaaaacacacatagcagcaccctccatgctccattacagtgctcttctgtgtgtgtgtgctgggagtgagagggtaaaatacacatagcagcacactccatgttccattacagtgcacttctgtgtgtgtgtgctgggagtgagagggtaaaatacacatagcagcacactccatgttccattacagtgcacttctgtgtgtgtgtgctgggagtgagagggtaaaatacacatagcagcacactccatgttccattacagtgcacttctgtgtgtgtgtgctgggagtgagagggtaaaatacacatagcagcacactccatgttccattacagtgcacttctgtgtgtgtgtgctgggagtgagagggtaaaatacacatagcagcacactccatgttccattacagtgcacttctgtgtgtgtgtgctgggagtgagagggtaaacacacatagcagcaccctccatgctccattacagtgcacttctgtgtgtgtgtgctgggagtgagagggtaaacacacatagcagcaccctccatgttccattacagtgcacttctgtgtgtgtgtgctgggagtgagagggtaaatacacacatagcagcaccctccatgttccattacagtgcacttctgtgtgtgtgtgctgggagtgagagggtaaatacacacatagcagcaccctccatgttccattacagtgctcttctgtgtgtgtgtgctgggagtgagagggtaaaacacacatagcagcaccctccatgctccattacagtgcacttctgtgtgtgtgtgctgggagtgagagggtaaaatacacatagcagcacactccatgctccattacagtgcacttctgtgtgtgtgtgctgggagtgagagggtaaaatacacatagcagcaccctccatgctccattacagtgctcttctgtgtgtgtgtgctgggagtgagagggtaaaatacacatagcagcacactccatgttccattacagtgcacttctgtgtgtgtgtgctgggagtgagagggtaaaatacacatagcagcacactccatgttccattacagtgcacttctgtgtgtgtgtgctgggagtgagagggtaaacacacatagcagcaccctccatgctccattacagtgcacttctgtgtgtgtgtgctgggagtgagagggtaaacacacatagcagcaccctccatgctccattacagtgcacttctgtgtgtgtgtgctgggagtgagagggtaaacacacatagcagcaccctccatgttccattacagtgctcttctgtgtgtgtgtgctgggagtgagagggtaaaacacacatagcagcaccctccatgctccattacagtgcacttctgtgtgtgtgtgctgggagtgagagggtaaaatacacatagcagcacactccatgctccattacagtgcacttctgtgtgtgtgtgctgggagtgagagggtaaacacacatagcagcaccctccatgctccattacagtgctcttctgtgtgtgtgtgctgggagtgagagggtaaaatacacatagcagcacactccatgctccattacagtgctcttctgtgtgtgtgtgctgggagtgagagggtaaatacacacatagcagcacactccatgttccattacagtgcgcttctgtgtgtgtgtgctgggagtgagagggtaaatacacacatagcagcacactccatgttccattacagtgcacttctgtgtgtgtgtgctgggagtgagagggtaaaatacacatagcagcaccctccatgttccattacagtgctcttctgtgtgtgtgtgctgggagtgagagggtaaacacacatagcagcaccctccatgttccattacagtgctcttctgtgtgtgtgtgctgggagtgagagggtaaaacacacatagcagcaccctccatgctccattacagtgcacttctgtgtgtgtgtgctgggagtgagagggtaaaatacacatagcagcacactccatgctccattacagtgcacttctgtgtgtgtgtgctgggagtgagagggtaaacacacatagcagcaccctccatgctccattacagtgctcttctgtgtgtgtgtgctgggagtgagagggtaaaatacacatagcagcacactccatgctccattacagtgctcttctgtgtgtgtgtgctgggagtgagagggtaaatacacacatagcagcacactccatgttccattacagtgcgcttctgtgtgtgtgtgctgggagtgagagggtaaatacacacatagcagcacactccatgttccattacagtgcacttctgtgtgtgtgtgctgggagtgagagggtaaaatacacatagcagcaccctccatgttccattacagtgctcttctgtgtgtgtgtgctgggagtgagagggtaaacacacatagcagcaccctccatgctccattacagtgctcttctgtgtgtgtgtgctgggagtgagagggtaaaatacacatagcagcacactccatgctccattacagtgctcttctgtgtgtgtgtgctgggagtgagagggtaaatacacacatagcagcacactccatgctccattacagtgctcttctgtgtgtgtgtgctgggagtgagagggtaaaacacacatagcaaaaagttcaccattttagccatctgaagtgtacggttcagtggcattaagtatattcacgttgttgcacaactgtcaacatcattgaactccagaacattttcatattcctaaactgaaattgtatactcattcaacagtaactcccacatccccgttaccccagttcctggaacacactatgctacttttcgtctccatgaatttgacgattttaggtgcctcacgtaagtggaatcatacagtatttgttatgcttatttcactcagcgtaatgtcttcaaggttcatccatgttgtagcatgtgtcagaattttcttcctttttaagactgaacaatattccattatatgtgtgtaccacattgtgtttatccattcatccaccagtggagctcagctcactgtaacctccgccttccaaactgaagctgtccacccacctcagcctcttgagtaactgggactacaggtgtgtgccaacatgtctggctaattttttttgtaatttctgtagagacagggttctgccatgtggcccaggctggtctccaacttccaagctcaagtgatctgtctgcctcagcctcccagagtgctgggattacaggtgtgtgctactgtgcccggctgagaccttacttttaattcttttgtgtatatacccagcagtagatcacattgtaattctgtttttatttttttgagtaactgccatactattttccatagtgtttataccattttatattcccaccagcagtgcacaagggtttcagtttctccacatccttgacaatacctgttattttcttttttttttcttttaagccttttttttttttttttttttttttgagacagggtctcactctgtcacccaggctggagtgcagtggcatgatcttgcctcactgcagcctttacctacctcctaggctcaggtgatccttgcacttcagcctccaagtagctgtgactacatgcatgtgctgccatgcccagctaatttttatatatatatatattttttttttttgtggagacaaggtttcaccatgtttcccaggctggtctcaaactcctgagctcaagcaatcctcctgcctcagcctcccaaagtgctgggattacaggcatgagccaccatgcctggccaacacttgttattttctgggtgttttttgtgttttttgtgtttttttttgttttgtttttttttttttttttttgagacagggtcttgctcagtcacccaggctggagtgcagcggcatgatcacagctcactgcagcctcaacctcccaggctcagatgatccccccaacctcagcctcccagttagttgggaccatgggtgcgcaccactgtgcttggctaatttttgtatcttttgaagagatggggtttccccgttttgcccaggctggtctcacactcctgggctcaagcgatttgcccaccttggcttcccgaagtgttaggattacaggcgtgagccactgtgcccagccttattttctgtttatttgatagtaaccgtcttaatgggtgtgagggagtctcattgtggttttgatttgcatttttaaatgttgagcatctttcttgtgccatttatatatcttctttggagaaatgtctattcaaatattttgcccattttaataattgggttgtttttgttgttgagttgaagttcttttttgttgttgagacagggtcttgctctgtcgcccaggcagtggcgtgatcacggctcactgcaacctttgtctgctgggctcaagctgtcctcccatgtcagcctcctgagtagctgggactacaggcatgtgccactacacctggctaatttttgtatttttggtagagtcagagtttcgcgatgttgcccaggctggtctcaaactcctgagctcaagtgatcctcacctcaccctcccaaagtgctgggattatagatgtgagccaccgtgcctggctatagaagttcattatatattctggatattaaacctttgttagatatacagatgcatgcaaatattttctcctgttccatagattgcctttttattttctcctcttttttttttttttaggggcagggtatcactctgtcggccagggtgatcctcctgccttagcctctggagtagctgggattataggcatgcaccactatgcctggctaatttattttctttttttcatttttttgtagaaacagggcagatctcactatattccttaggctggtcttgaacttctgacctcaagtgatcctcctgcttcagcctcccaaagtgctaggattacaggaatgaaccactatgccgagccaggagtttttaatttttatgaagttcaatttatgtatttttttattttgttgcttctgcttttggtatcacattcaagaaatcattgccagattcattgtcaggaaacttttctcctatgttttcttctgaaagttttattattttagctcttacgtctaggtctttgatccatttttagttaatttttgtatacagcattaggtaaggttccaacttcattattttgcatgtggatgtccagttttctcaacatcatttgttgagaagacttagccacatggtttctttctttttttttttttttttaatttttattttgagacagggtctccctctgtcacccaggctggaatgtagtggcacgatctcggctcactgcaacctccacctcccaggctcaggtgatcctcctgcctcatccttccaagtagctgggactacaggcacgagccaacacacctgactaatttttgtattttttgtagagacagggtttttccatattgcccaggctgatctcgaagtcctgagctcaagcaatctgccctcctcagcctcccaaagtgctgggatgtcaagcgtgagccaccgcacccagcctcgccacgtgggtttttggtgtcccacggtcaagtgctccgtttttagcaggatctactagcatggcagaagctggttttcaaatgttgtcattctcagctgtagacagcatggtctcgctccagattctcagagggtctgttaggattcttgtcgtggtgcttgccgtaaactccacctggtaccttgtgccaccacagacaccataggatccgccaaatgatgtcccaagcagcagagcatcctttcaactctgggccacaccgaaagctcgccttccatgtcagttgatacataggtcagagcagtattccaaaatgcggagtatgttgtctccagaacctgaagtctcctttcgggcattgtgcttccttcttggtggtagcatgtaccaggtgaaataatttgatctttacatcggagggaatatcctgggatacctggatcacagccttaaaaacttcactcatgtgcttcgtaaggttcatctgcaaccctcccgagcacacgtatcttaccacgtgcacttgctgtttcttgttcatgccgtctgatttaacgcgatatcatcagtagtgagctactggccatctgtggagtagccagatccagattcttttttttgtttttgtttgtttgtttgtttgtttttgagatggcgtctcagtctgtcacccaggctggagtgcagtggcgtgatcgcagctcactgcaacctccgcctcccagattgaagtgattctcctgcctcagcctcccgagtagctgggactacagcgcacgctatcacgcccagctaatttttgtactttttagtagagatggggtttcaccattttggacaggctggtctcgaactcccgacctcgtggtccacccgcctcggcctcccaaagtgctgggattacaggtgtgagctaccgcgcccagcccagattcttttatactgtattgacagaaagtaaaagcgttaacatggccctgggaaagactataaaagcacactgctgtccatgtcacatgatgtgaactgcctctggtcttttgaggggtaggaaagaatccatttgcctaattagtggccacttaccatgtgcctgagactaagtaattctcttctagcaaaggtgctacatctggcacaatgactgaaattgggacctactgggtagtagtctactcttatcttccagaatccatctggttttgtatgggtcatactgaggaatgaaatgaggctttcataaggacctccacctctgcattctttaggtctttattgatcgtcttgactgggtagggaggggcagtttctgaggctttcacttagcttgccccagaagccaagaagctaatttggaggtactgtcccccacctagtatgtccattttaagcatttgggaactgaagaaatgcccattgatttggtggatccagtagacctgctgtgagttggacgtgggccacaattccatttattccatggtccccacgtgccccagtgccatgatgatgcttcacgttatctggtgtcggtgtcagcttagaccctgtatccagcagtccttaaaatgcccaggtctttcctcttccccagtatacagttacttgaataaatggctatagaccctttggaggatgtggggaatcattaccatgaatatctactctgtggtgtcgcagggtcttaccttctaggagttccagcctcttctttaggtaattgtctctaggacttaaaactgacttggggctggtaatcccagcactttggggtggctgaggcgggcagatcacgaggtcaggagttcaagaccagcctggccaacatggtgaaaccccatctctactaaaaatacaaaaattagctgggcattgtggcatgcgcctgtagtcccagctactcgggaggctgaagcaggagaattgcttgaacccaggaggcggaggttgcggtgagctgagatcatgccattgcactccagcctgggcgacagagcgagactctgcctcggaaagaaaaaaaaaaacggactcgggcctgaaaaacgagtcagagattgtgattttgtttggggtgcagccctcagcctcttttccatctttgacttatcttttattgtttgagctatactctgttgactacccatctaccttgctgctagaaacgccacgttctgtaaaccatctccatatcaagtcgctctgaaatccctttttatgttgttttttttaattaattaatttttttttttttttttgagacagagtcttgctctgtcgcccaggccagagtgcggtggtgcaatcttggctcactgcaaactccacctcccgggttcaagtgattcttgtgcttcagcctcctgagtagctgggattacaggtgcacgccaccacgcccagataaattttgcatttttagtagagaccaaggtttcaccatgttggccaggctggtctcgaactcctgacctcaggtgatccgcctgcctcagcccaaagtgccgggattacaggcatgaaacaccacacccggcccgaaatccctttttagcgtttgcttccttggcccagtccagacctaagctatcttaggttgagttctctgggaaacagactgtacagtggagatttgcttgcaggaattttattgggaagtgagggaacttaaactgggattcagttgcagcaggcctcgtccaacacgatagggatctctgaagctgggatggctcttcagagatatcctgaactgagcaaggggattggatttttgtgtttcctcattgaccaggcactggatatgggctgtccctgaggaatgagaggcagaaacttgggtgaggcagttcccttgtctggggattcaactacaagctatcagcaggcagcattcctggcagttggcagaatgagcccatcagccccgaagagcaagatctgagcagtaaccctcagcagccactaccattcccttttagaattagctaagaagtggccgggcgcagtggctcccgcctgtaatcccagcactttgggaggccgaggcaggcagatcacgaggtcaggagatcaggaccttcctggctaacacagtgaaaccctgtctctactaaaaatacaaaaattagccgggcatagtggcgggcgcctgtagtcccaggtgctcgggaggctgaggcaggagaatggcgtgaacccggcaggcggaggttgcagtgagccaagaccgcaccattgcactccagcctggacaacagagcgagactctgtctcaaaaaaaaaaaaaaaaaaaaaaaaaagaattagctaagaagtgccctggccccttttctctgaatggaaatacctgatgttttacgaagtagagctgaagtctagatacaaactattcaattttaatttgaggttactgttttaatttggggttacaattgttttaaaaaaaaaatagaagggagatcctttaaacagaaaaaggttacttacttgggacatttaataatatgtgcttgctttccatgagaattgcagggagctagaagacaagaaaaagattcagaatctcttggctcttgtgggaacagatgctggagaagtgacctatttttgtaaggagcctcctcacaaagtaagtaatctttggtgtagcatggtgagtgtggctttacaagtcacaggctaaggcccatcatcagaagaactttagtatccgctggagaaggcagatggagaattagccatcacagtgccttgtttgcctgagtttttaaagcatttttcttcgaaaaccttgggaagtagcattatttaccccatttcaatgtttagaaacctgaagcacagaggggtggctgttttagctgagacagagaggaaagcaggagcagactatgtgtgggagcaagttttgatgcttaagtttctttttaaatctttgtttatactgattacaaatgtaatccatggtctttattaaaaacaaacacagagtatagtaatctatcatataaaagtggcaggttctcataatcctataccccagagataatccattagtaatagtttggtgtatatacttccatctctttcttcattcctatagaaatagttatgtgtctgtgtatactatttctattttttcacttctataaacagttcctgagcatttttatacatatctgtatacgtatacttctgttttctaaaggtccttggccaagagctactttttttttttttttgagacaaagtctcattctgttacataggttggagtgcaatgcgcaatctcggctcactgcaacctccgctctggggctcaagcactcctcccacctcagcctcccaagcagctgggactacaggtgtacaccaccacgcccagctaatttttgtattttttgcagagatggggtttcaccatgttgcccaggctggtctcgaactcctgagctcaagcagtccgcccaccttggcctgtcaaagtgctgggattacaggcatgagccaccacacccaccaaagagctgcttttaaaaaaacaataaaaattttaaaaaaattttagagctgaggtcttggtatgttgcctaggctggactcacacttctgggcttaagcaccatccttccactgtagccagccttccaagtagctggaactacaggggtgcaccactgtgccccaagctgtttttgtttttgtttttaatcatatattactaaatagccctgcaattttgtttatttatttatatttatttatttatttttcaagatggagtttcgctcttgtacaccaggctggagtgtaatggtgcaatctcggctcaccacaacctccgcctcccaggttcaagtgattctcctgcctcagcctcctgagtagctgggattacaggcatgtgccaccacgcctggctaattttgtattttttatagagatggggtttctccatgttggttaggctggtcttgaactcccgacctcaggtgatccgcccaccttggcctcccaaagtgctgagattataggcatgagccaccgcacctggccttatttttatttttttagaaacaaagtctcattttgttgcccaggttggagtgcagtggagtgatcataactcactgcagccttaagctcctaagcttaagcaatcctcccaccttagcctcctgagtagcggggaccacaggcacatgccaccacacctggcctacctttttaagtttatattgtcaacacagggttttatccagtttgctactttgcctgtgtggtctgtcatgtgcatgacatccttatatgatcatatcagttttgactaatttaacttctagtgttcaatctgcagaactaaggctgaaaagtaaaatattacgtttataggaaggctacttcaataccagtttttgcttcttcaggtcaccattctccaaaagactatccaggctgtaggtgaatgtgagcagagtgaatcttcagctttcaaagcaggtaacaaccatataacctattagaaattctcatcaatgcagaattgaaaatcacagtgcaggctgggcgcggtggctcacgcctgtaatcccagcactttgggaggctgaggttggtggatcacctgaggtcaggagttcgagaccagcctggccaacatggcaaaaccccatctctacataaaatacaaaaaactagccgggtgtggtggcaggcgcctgtaatcctagctatttgggaggctgaggcaggaggatttcttgaacctgggaggcggaggttgcagtgagctgagatcgtgccattgcgtgacagagcaagactatctccaaaaaaaaaaaaaaaaaaacagaacacacaattggaaatgttttcctactgtacagtgataattgatgttcataatgatgcctttggtggtctaatgtcttaatgagcttcttgaatcatccaaggaattaaattttgctcagttcttttttttttttttttttcttttgagatagagttttgctcctgttgcccaggctggagtgcaatggcgcgatcttggctcattgctgcctctgcctcccagattcaagcgattctcctacctcaacctcctgagtagctaggacgacaggcatatgccaccacacctggctaatttattgtattgtattttactttgtgtaggaaggggttctcactatgtcactcaggctggttttgaactcctggcttcaagtgattgtcctgctttggcctcccaaagcactgagattacaggcatgagccacaacacctggccttattctgatcgaataggatttactaagaaaatagacacaactattttagtggttgattctaaggaaaatttagtggttgattctgccagaagatgaatatgattatttaggtgacatcctgcagagttcccttatagagattcctatttgaaaagttaagcactatgattatgatgtttccctttgtcttccgaatcccttcattagtgagaaccccttcattacccttacaggtaaatgaatctgaactcctctgcgtgggaaatactgatatttcaatagcacacagaaaagctgagtaaaatcttcttgatggattttgttttctattttagatcctaaaataagcaaaagaagaccatcgagagagagaaaagaaagttctgagcattaccaaagagacatacagacactcatcctacaggtaaagaatgtattttggcagaccaagatggcttttatccacaggtgcagctctatgtcacataccctcagtgtcatgtgataagtatctccttgcacacaggttacatctaagcatcatgtggttaagaaaattgagattgttcctaatttctaagagcttatattttgaaaccatccttttctatttgaacattcttaaggtgctactctgaaccttcaattcaatatactaagccccatccaccaaaaccattacaaggtaagaattcactggcctagggatatgcagagattgcagagggaagcttgtctatgctgatagatcaacatttgatggtatattcatttatttagtgcttaggttccaaagtctaggaaagtaatgaactgttctcttacctcctggttatgtgtcatttggaaccatgatttttcatctagttgcactaaagtttctgtccttactgtgttaaatctctgttgatttaaatgacagtttctacctttggccagtatctccatgtggagtcatgacaaccagacacagagaaggaaattacattatattcattttgctctgctttttgaaaccaaaaactaagaaaagagtcattttgcttctgtgcaggaagggtgtcttaaagggagacagtcaagggagatagtgaaaaggcaaaaatcacagggtgagaaaactggattttgtagctttgtttgtgtgttgtagatgctgggtttcgtttggacaaagaatctactcttgtatagcctaaccccatttataagacattaagaggaactgggctgggcatagtaatgcctgtaatcccagcattttgggaggccaaggcgagttgattgctggagcccaaaagttcgagaccagcctggacaacatagtgagaccccatctctacaaaaattaaaaatgaaattagctgggtgtggtggtacacacctgtagtcctggaggctgaggcagggaggactgcttgagcccagggggttgaggctgcagtgagctatgatcacgcccactgcactccagcctgggggacagagcaagaccttgtcttgaaatgaacaagaggattaggattgagatgtttttgtttgtgtttgttttttaatttttctggagaaaggctcacttttcctagaggtatgaagtaagtggaagtagggctggattcctcacccctttttggcctgtctaggtggaagcactgcaggctcagctgggagagcagaccaaactttctcgagaacaaattgaagggctcatcgaggacagacggattcaccttgaggaaatacaagttcagcaccagagaaatcagaacaaaatcaaagagctaaccaaaaagtgagtgtctaagaaagctgtacctaacgggtattgtatttttctgagtgacttaaaagttaacattttgtacttgaacaacagcgggtcatagaactaaagggagccttgaaaagactgtcttcctcagaaacccccgcctctacgtaggtgagtacctcgcttttccaggcgtgctgttgaagagctgatgagtatttcacgtgctccttttaatccattttggtgttttagcttgcttctggtggctaagaagtgttcttaggccgggtgcagtggctcacgcctgtaatcgctcctgcctgggtgacagagtgagaccctgtctcaaaaaaaaaaaaaaagtgttcttttatccactgatatactatctgactcaatgtagtaagacccttttcttttgtttgccccttcatgaatatggaaaacatgagtttacatatctaaaaaaaactgcacactcagtattttaatcagaactctgccggtgcttttatctagagacatgttatcatttttggcttctatgaaatttttgtcccaagaaaggcaggattatatttttttctaacagattgagttggtgtagtgtattcttggttatcaaaatactcatatagctttgggattttgaattggtaaatatctatgatgtgtgaaacagcatgatacatactgtacgatctcaagcccataaaattggatgttgtgtctacacacacgcaggacgtagaacgtcctgtaaactttacagtttacaaactgtaaagtgcttctgattgtggatgactttgttctttgcttcttgtgtgttttagtttcctataatgcacatactttaaaaaaaaaaggttatttttaaaatctgaaaaaataaaaacaaaaaatggcaaactctgtcctcattgtttttgttcctaacctgcttacctttctttacctgtctgcagtctgacttcatccccaccattttactaaacatgccctttctggggttctggggtcaccattgacctcttaacttttctttcttttttttttttttttggagactaagtctcactctgtcgcccaggctggagtgcagtggcgtgatcccggttccctgcaaccgctgcctcccaggttcaagcgattctcctgcctcagccttccaagtagctgtgattacaggcatgtgccaccacacccagctaattttgtatatttagtagagacggggtgtcactgtgttagccaggctgatctagaactcccaatctctggtggtccacccgcctcagcctcccaaagtgctgggattacaggcatgagccaccacgcctggcctacctcttaacttctgagaccagttatatctcttcagttcagtccttattatacttagtatcttcctgcatgtttggcatcactgatcagcccctccttgtaattcatttcccttgatttctgcagcacctgtctttcttggttcttctacctatctaaccccttcacccttttgcctggttccagtggccagacctatgccataaggacatcctcagttgaatgtgtttgagcatgtcagatttaccattactgaaaccacgctgttgtttctcccaacaaatgctcccatccccgtctcaaacctacttttctgtttttcatctagtttcatggtatcacatgtattccgtttccaaatgctcccatccccgtctcaagcctacttctttctgtgtttcatctagtttcatggtatcacatgtattccgtttccaaatgctcccatccccgtctcaagcctacttctttctgtttttcatctagtttcatggtatcacatgtattccatttccaaatgctcccatccccgtctcaagcctacttctttctgtgtttcatctagtttcatggtatcacatgtattccgtttccaaatgctcccatccccgtctcaagcctacttctttctgtgtttcatctagtttcatggtatctcatgtattccgtttccaaatgctcccatccccgtctcaagcctacttctttctgtgtttcatctagtttcatggtatcacatgtattccgtttcccaagcttgaaaccacaggatcatcttcaactcttaactttcttattccttaattccaaaccctatgaattataagcctaaaaaccccctcaagtccattctctgctctctgatataggcagttctacatggagcacaacatacacaaaagcaaagctgtttttgatactacagaacttgtgttaacttgtcagaactccacaacttagtacttccttgtcttattcctaggaatggtccatacttatgcaggctatgtgtaaatatccctgtagtccttctaatcatataacccgaagttagcactcaggaaaatatctcctgtctgattgttttgtttcattttttccagtaaagacagggtcttaccctgttgcccaggctggagtgcagtggtgtgatcatagcttactgcagccttgaactcctgggcgcaagcaatcctcctgcctcagccttccaagtcgctaggattacaggtgcataccaccaaacctggtttatttttattattttttgtagagatggggtcttgctatattgcccaggctagtctcaaactcctggtttcaagcaatcctctcacctcagcctcctgaagcactgagattacagacatgagccactgtgcccagccttgcactctcattcttagtacattaattcaaactctattcctttgtttaaattgttcctattgctgatcctttgtcttttttttttttttttttttgagacagagtctcgctgtgtcgtccaggctggagtgcagtggcacaatctcggctcactgcaagctccgcctcccgggttcatgccattctcctgcctcagcctcctgagtagctgggactacaggcgcccaccaccacgcccggctaattttttttttttaattgtatttttagtagagacaaggtttcaccgtgttagccaggatggtctcgatctgacctcgtgatctgcccgcctcggcctcccaaagtgctgggatttccttcttagtagagacagggtttcaccatgttggccaagctggtctcgatcctgacctcaggtaacctgcccacctcagcctcccaaagtgttgggattacaggcgggagccatcgcgcccggtctgctatgtttcttttaacatagtataatgtgtttgcatttggccagtatttctccaccttcatttttatttttagtatttttgcacttaagtatagcatcttgacatttcaatgggttttgtttttaaggaacagatattttaatattgtcatagtaatttgtaattttatatctgttttccagaataccagtaaccttccttgtttagcgttatctgcatatctgagcacatgatcggttccttccattagatggatcttcctaagaagggcatgaaatccagggccgttaatgactgccctttgggtatcactttcaagctacttgtattttaacaagcctatagtttcccagtttgagattgagaagataatgtaagacagaataaaataactcattgaaagtgagagagacccttgtggtaattgaatcaatctctctctacatacacatgcacacatacctgactgtatatattcaccttgtgacatttactctactgtgtgcttggcactctgctgtcatttcctcttatctgtgcactctgttactcatgaaaataagtggatctcacattatttgtttggtagaaaaatacagtgattgcttcatggtatttaatactcttgcaagcagccagatcattcagtatagcatttttctgggtggtaatgttaaactgatgagttgctaacttccagggatattgttttttaaagatagagacgttgtctattcctaaatttcaggaaatagtcaccatgaatctgttaactgcctgtgtatgtccagtagttagtattatccttgacaatctcatggcattggggcaaaaataataaataaggtatatgctttcactcaggctgggaaaaagtgcatgttgacagttaaaatatgacagatgagcaagtgttgaattataagacaagggaacattaacctgggatggagtttcagagaatggaggaattaaaataggctaaagttgttggaaatgacttcatacaggaagttgatttttaaaaaagtaggccaggtgcagtggttcacacttgtaatcccagtattttgggaggctggggcgagaggagtgtatgagcccaggagttccagaccagacaagcctaaggaacatagcaagaccccatctccacacacacacaaatttttaatgagctggcaaacaccctgggaggtggtcccagctgcttaggaggctgagacagaaggattgcttgagcccagaaggtcagggctgctgtgagctgtgatcgtgcctctgcactccaacctacgtgacagagcaagaccctgtcttaaaaaaaaaaaaaaaaaaaagttctttttaaaataaacaaaggataagattttgatataggcagttctacatggagcacagcatacacaaaagcaaagctgtttttgatactatagaatttgtattaacttgtcagaacaccgtgatttagttcttccttgtcttattcctaggaatggtccatagttaacgcaggctatgtgtaaatatccctgtagtccttctaatcatataatctgaagttcgcactcaggaaagtacctgtaaagaccagtctatgaaccagtgagcatgggtagatacattatactttacccagtaaaacatgtaagattgccagtgatcagatttttaaacctgctaatattttacaaaatttatatatcacaccattttaaaagaaccactctcttccattttggaataatccttgctttcaggtgtgctgtgtgcgcatcctcatgtctgcatttatactttctttcctagtcttcaccacacccaagaactgctctatgagagcaccaaagattttctgcaactcagatctgaaaaccaaaataaagagaagtcatggatgcttgaaaaagataatttgatgtcaaagattaagcaatatagggtgcagtgtaagaagaaagaagataaaattggaaaagtgttgcccgttatgcatgagagtcaccatgctcaaagtgaatatattaaggtaatgtccttatgtcgtaacgaagttgtttatttttctgggagagttgaaggaattccaaagaacctacaatttgtaatgtaagatccattcagtccaggaagctctggtagcagctgcctcaagaactaggtttcaaagagcagctgatcgttgtagtatttggggattcaaaatattagacttgttgattcattcattcattcattcaacaaatatttattgtactcctggccgggcacagtggttcacgcctgtaatcccagcactttgggaggcctaggtgggcaaatcgtgaggtcaggagttcaagaccagcctggccaacatggtgaaaccccgtctctactaaaaatacaaaaaaaaaaaaaaaattagctgagcatgatggtgggtgcctgtaatcccagctacttgggaggctgaggcaggagaattgcttgaacccgggaggcagaagttgcagtcagccgagactgtgccactgcactccagccccgatgacagtgcgagactgtgtctcaaaacaaacacaaaaaaacataaatatttattgcactcgtactatgggttaggccctagagttacagtaatctaaacaaggtcttccctcatggtgtttacattttaatgggtgagaaaaaacagaaacattagcaaataactaagaaaattatagattaggccagacgcgatggctcacacctgtaatcccagcactttgggaggccaaggcgggtggatcacctgaggtcaggagttcgagaccagcctgaccaacatggtgaaaccccgtctctactgaaaatataaaaattggtggggcgtggtggtgggcacctgtaatcccagttactcgggaggctgaggcaggagaatcacctgaacccgggaggcagaggttgcagtgagctgagatcatgcgattgtactccagcctgggcgacagagtgggactccatctcaaaaaaaaaaaaggactttgggaggcagaggtgggtggatcacgaggtcaggagttcgagagcagccttgccagcacagcggaaccctgtctctaccaaaaatataaaaaaatagccaggcgtggtggcggacacctgtaatcccagctacttgagaggctgaggcaggagaattgcttgaacctgggaggcagaggttgcagtgagccgagatcgcgccactgcactccagcccagtgacagagcaaggactccgtctcagaaaaaaaaaaagaaaaaattatagattataaaatgcggtattaagggaataaaagaattacatgaaaattatatgtagttgctggaagtccattgtattaatagaaggaatgcacagggacactctcttatatctagtgtttctgctgagacctgaaaaatgggactaagcttgccatacagaccttgaggaagaacattcctggcagagggaagagcaagtttataggccctggagtatgttcaaggaaatggaaggctgtcatcatggttgtagaggaataaataaggaggaagtggtatgctctttaagaagccagcattggcagcagccagttgtggagggccttgtgcatcatcgtatggagtgtgaacttagctctcaatagtgttatgtatttgaagggttgtgtgaaataagtaacatgatctgatttgggtttttaaaagatcattttaactgctcaatagggcatgtataataagcgttgttgttaatatttcttcctttttaaagaagaactttagaaatgtagcccaaaacatatattgtaatgtcttccttgggacagcttctgagctccgttatctgagtcttcccagagccaaaaatatttgttttaatttttactgtgtacactttagaaaaagggcttaagagactggtctagaagtagattttcagatgttcctcaaagttccttgtcatctggttccttaactcattttgtacctctggaaatcccttcttttctttctttctttgcctaaaagctacttgaattacctgaattgtagaactgagtgttaatgttttttgtccctttgacttgtagtccctaaaagataagttagtacaagagaaaaagctgtccaatatgtaccaagagcagtgcatttccttagaagaagaacttgcccgaattcgtgaggaagagggaatgaggagagagatcttcaaggtacgaaattatctgccacttgtaatggaataggaagtgcagatggctggggaagacgcttccctcaccttcgtaaatgccttcccattccccatatttaggatcgcactaacaagatggggaagcgtttacagataatgacaaaacgctatgaggcattggagcgtcgacgtatcctggaagtagaaggctttaagacagatattaaagttctccgacagaaactgaaagacttggagcaaatgttgtataaggtaattgctggtcctgaattgccacgagggagagaagaggtgtaagtgagggaacatggtcacgagggcccctgaaaagaaggatgtgctgtttccctgctggtaaacactaacagatcaccatcttcaagcctccctgaaaattagttcaagaacatgctagagggaaaataaaaagaccctgaaatcattgaacgactgcatcattcatacttcgatgtaagctaaacagattgtcatccctcctaattcaagaagtagattaaagaatcgtgtctgtcttacagttggggagggtgagtaattgagtgatagagtacttttttccagcagacacagttctttagaatacaagtcgcctcaagagtcttcttaatgagatttagccagttagcctgtgttccagacaaggttagttgcagaaaagaggagacgcctgctttcattctgtgacaaacttaccagtagtgttgcgctttcattctgtgacaaacttaccagtagtgtcgcttatcctggcctctcttactcctctttcatggtgcattgatctctacctcaagcctcctttattgcatgggaaggattttcatgagatttctgccttaattctacattttccttctttagttagccactgaacaaaggatggaatttatcctatgtactcaaaatctcacaaaaaggagctagcatagctgtgtctttttgactgatatcgctcccctggcatatgccatcatcatttctttttttttttttttttcaaacccctaggcaacagttaatgcccgggcaaaccaggatcttgcccttctgtgtgaggtccgtgacagcaatagacgggcacataagatacaaggagaactgaagaatcttaagtcgaaagtgtttggtctggagaatgaacttagactctgttaatgtctacttttggaaatggcccccatttagaagaggtgtgcttcttgaaacctgaggacaaggtcatctgctgccagaaaatgtaaacctgagttgactagagtggtggtattcattattgtaaagacagcttgaagaatcggggaccactaggaaagcttttcttgcatactcagcttgctttatcatttttgctgtccttttaacacttgcgaggagtaggggcctggtcctgaatgacttggaggctttcattatttatcctgtctgtattgaccggtttttgttttttcagaaggcagtgatgatgaaaacttaggaagaaggtattttgcaataagcttggctgagtgtccatgggaagaatactttccctaaagagagagaagcactcacagaggctgcctttctcctgagctcggggagaaggcagcacatcacaacctgtcacattgaaataggcgctcattctgctatttcaccttccgtcctgagcagagcctgaattacgtttttgggcaatttcatggtgtttcaccagagggcgctagagactcaaacgaaatgtccatctggaaagattcgggagacactttgccgaggggatgaagctgagatgatgcttgtatggaaagtttgatatttttatcagtcacatggcttttgaaaaatgatgtatatattttaaattaactattttcaataaaatatttcactcaaaagattttctttgagttttctgtaacttcttctcaatactatatttatgcttcgttaatgactcacgcagctcagtttacgttcttgtcccatggcctctgcagttttgtgcaagtgtacaaggttttttggggggtttttgagacagtttcactctcgtcacccaggctggagtgcagtggcgtgatctcggtccactgcagcctccgcctcccgggttgaagtgattctcctgcctcagcctcccaagtagctgtaattacaggcgctcaccaccatgctcggctaatttttgtatttattttattttattttattttagtagagtcagggtttcaccatgttggccaggctggtcttgaactcctgacctcaggtgatccacccgcctcggcctcccagagtgctgggataacaggtgtgagccaccacacccagcccacaagtttttttaaattactcctttgaaatcatctagtgttggagataacaaagctagtacgaaggggatgacactaaaacttcatccgtttttaggcaaattgcatttgggacaaaatagttgtttccatacccagaaagcctcttgatagtaagttggtctttgcttaagatagcatcattctgatttacccaggacaaaggagagaacccaggttttcatatttaaaatggttaacaatgtgtaaaggaaggtggtgattgtactgcacgcagaagctgttacctttcttgagaaagtctgtgatcagccaggtatggtggctcatgcctgtaatcccagcactttggtaggccgaggtgggtggatcacgaggtcacgagattgagaccagcttgaccaacatggtgaaaccccatctctactagaaatagaaaaattagctgggcgtggtggcacgcacctgtaatcccagctactcgggaggctgaggcaggagaattgcttgaacctgggaagcagaggttgcagtgagccgagatcacgccactgcactccagcctggtgatggagtgagactccgtctcaaaaaaaaagaaaaagcctgtgatagcagatcagtttttttcattgatcagttgggacaaaaattcttaagagtgccctgctcccaggcctcagagagatttacagaagtgcatgattcttccttctgtcctaatacttagggaattggcttttcctgactattacttttgttgttgctggcaaaacaaaaaggcttattaaatcagagaattttggagtaagaagcaaccttaaatatcatataatccaacttacttacaaatgactctgagacctactaccattgacttcagcaatcagttgataatgtttctaacatcctggtctcaattccaataacattcatctttatattaaccacccactggtgtggccactcttcaaacctcacaattggttaaaactctgtcaccaagaagcagcataaaatagtggaaagggtacaggctttggagaatcacagatctggattcaatcacacctcttactaaaattctccaggctctagtctcttcgcttgtaaaagagacaaaaagctacctgtttcagcagagtgactgtgaggattaagaaagagaaaatctagtatccagagtatataaagagctcttacaactaaattaaaaaaacacacacccaattcaaaaatgggccagggatctgcatagacatctctccaaaaaagtcgcacaaatggccaataagtacgtggaaagatgctcagcatcattaaggaaatggaaactaatgcgataccgcttcacgctcactaggatggctgtcgtcaaaaagtcagcaacaactggataaggatgtggagaaactagaggcctcatagattgctgacgagaatgtcaaacggtgcttccccttcaaaaaacagtctggcagttcctcgaaaagtttagagttaccatatcacccagcaattccactccataagtatatacccaagataaataaaaatatacacccccacaaaatcttctgcatagatgttcatagcagtattattaataatagaccaaaagtggaaaccatccaaatgtccgtgagctggtgaatggatagacaggatacggtatatccatatgatggaacattagcagccatggaaaggaatgatgtagtgatacatgctactacaagggggaaccttgcaacgttttgctaagaaggcagaaacagaaggccacatattgtacgattcccatacacatgaaacgtccagaataggcaaatccatatggaaagcagatgactggttgccaagggctgagaaggggggaataaggagtgactgctaatgggtacaaggtttcttttgccaaactgtgaatgtactttaaaaaccactgaattgaatgctttaaaaaggtgaattttatggtatgtgggttatatatcaatttttttttttttgagacatggtctcactgtcacccagtctggactgcagtggcgcaaccttggcttactgcagcctcaacctcccaggcttaagcgatcctccaacctcagccccctgagtagctgggactacaggcatgtgccaccatgcacagctaacttttgtatttttttgtaaagacagggatttgccatgttgcccaagctggtcttgaactcccaggctcaagcagtcctcctgccccggcctcccaaagtgctgggattacaggcgcgagccactgcacccagcctatatcaatttaaaaaaaaaaaaaacctccatgaaatgacttagtctggtgcctagcatatggtaggtattcagttacaatgagctgttatctgtattttggcttcaattgacttaccaattgctcaccattgccaatcagattccatgatgtatttaataccattcatttcttcatgcagcaatttatttcttttgctatttgttttgttttgttttttaagaaacaagtctctcgctctgttgctcaggctagaagtcagtggtgcaatcaaaacccactgccactttgaactcctgggctcaagcaattctcccccttcagcttcccaagtagctaggactacaggggcatgccgctacacccagttaatttaaaaaaaaaaaaattgtacagatagagtctcactatgttccaaggctggtgtcgagcttctagcctcaagcaatcctcctgcctcatcctaccaaaacactgggattacaagcatcccactgcacctggccccttaagtgcttttttttttttttttgaggcggagtctcgccctatcacccaggctggagtacagtggcgtgatctcggctcactgcaagctccacctcccaggttcatgccattctcctgcctcagcctcccaagtagctggaactacaggcacccgccaccaggcccggctaatttttttttttttttttgtatttttagtagagacagggtttcactgtgttagccaggatggtctcgatctcctgacctcgtgatccccccgcctcagcctcccaaagtgctgggattacaggcatgagccactgcgccggcctccttaagtgctttttatgttctagaaattatgctagatcttaagtttacagagaacactaaaacacttgtgctccaaaggctggtggggaagataaacatagaaaaaactcagtaatgaagtgcagttctatgggtgtacaggatagacatgtgaactgatcctcaaaagtgaatttggagacagacaagaagtgggaccttgtagacagagggacaacatgtatgaaggcaaggaagaacagaatatttggggaaatgcaagtacaggagacagttatgtaatacacaacataaatggcatgaaatttcacttaatacaattatgcaaacctgttaaatattccaagaccctttgaatcaattgaaaatgtttgggtttacttaaaactggagaaaaacaaatattttgtgttatgaagtcatgcatgaaaaataatttgaaatgcaaactcatttcttaaaaattaggggcaagggggccaggtgtagtggctcacaccagtaatctagtaatctcagcactttgggaggccgaggtttgctagagcccaggagttccacaccagcctgggcaacatggcaaaaacccagctacaaaaaatacaaaagttagctgggcgtggtggtgcacacctgtaatcccagctacttgggaggctgaggcaggaggatcactcgaacctgggagattgaggctgcagtgagccgtgtttgcacctgtgctacaaagcaagaccctgtctcaaaaaaagtgtgtgtgtgtgggggggggggagtaaaaactaccatgaaataataaatatatgaaatatttatttcctggtaaatctttgtacttgagatcaagctaaggcacaatcacttaatactaggatttattgcagtatctgcaggaacaaatcaaagcatagtgccaaagatctttgaaaagcgccatcattgtcatttcctttgcattttaaactttcttttaaccatatatatgagtaacttggtaataaatcacctttttatccatgaaacttatgtgatttttcacaaaataaaatagcctctggctatgttatttttggtccagtcttatgactctcgctgcctctccacccacaccatgttagttgggctactaagacttactgtaatatttgcaacacagcagattgcactatcatcactcactgcatctaggaacagaaggaagaagatggctgctgtcctcatccagaagagaaactcagggcctaagctaaagggagacattgagaataaagaggaagggacagaatcatttaggagtagaatggtcatcctatctttgtgatggatgagatgtgagagttagggaagagttaaggaggtggggagatcgcttgagcccaggagtttgagaccaacctggctaacatagtgagaccccgtctcaacaacaacaaaattaggcaggcacagtggctcacacctgtagtcctagctactcaggaggctaaggaggcaagattgcttgagtccaggactttgaggctgcagtgagttatgacagtgccactgtacttcagcctgggcaacagggtgagaccgtatctcaaaggaaaaaaaaaaggataattctctaacttcagagtttctggcttgaggtaccacgtgtccagtgacaccgttaagtgagcttcaatgtataggagaagcagcctgtttctagtaaatttgggaatagagatctggaagataagttagtattaaagacttggaattattaacatataaaaggtaattggatgtggatgagatccgagatgaaaagcatacagaaaaagaagagaagagggtcaaagaggggaaacctttttttttgtttgtttgtttttgagacggatctcgctctgtcgcccgggctggagtgcagtggcgtgatctcggctcactgcaagctccacctcctgggttcacgccattctcctgcctcagcctcccgagtagctgggactacaggcgcccgccaccgcgcccggctaattttgttgtatttttagtagaggcagggtttcaccatgttagccaggatagtctcgatctcccgacctcgtgatccacccgcctcagcctcccaaagtgctgggattacaggcgtgagccaccgcgcccggccaaagaggggaaaccttaacagtaagagaaggggtagccagtaagaaaggaatggtctgaataacaagaacatagtgttctggaaactcagggaatgagaacttcaagaagccagtggttgggagcattgtcaaacgctctagaagaaccatgtaaattagaattgaggtttggggatttagcagcaggtgagtttaaagcaacttcagtgaaatagagatggaagttggcttatattaggttgagggatgaggccagaaggaaaatgggaaatagcttcaaagttgataaagccaaggagaggagtttcgatagttttaggctggggaagacttaaccatattcacagactgaaagggaaaggccagaggaaggaactgaagatggaagagtgagaggtgtttctaagtaagatgctgggggaatgagcgctggtactgacgggtgcagtaaaagcagatgagttggtataataactctaaaggggcaagtaccctgttttcacagaggaaataaagttaaaccctccactgaaagtgagatagggtatagatgtgatggggagcttgaggagaaagtgaatgttggaaagattggagggagctgacaagagacaagtgatagactcattaggagtagctcttgatggacgatttattgagttgaactgcctgccagggagaaaatgcctagaatcgcagcaagtcatagtctgcttcatctgcccttctaacttcctaagtaggtaagggcacagagccaaaaaagatctagaataggcagaccagcagaaaaaaaggcaggtgaagagatagagctggaaggagggtttggctgcaaagtgaagggaggccttgcaaagaaaacattttgaaagggggctttaaatctctacgtgaaaacattgctttatcggcttaagctgtgaaatattccactcctggactacttggtagcttattttcaagttagccatacaaaaagcaactgtgaacacaacctagacttctggagattaattacttaattgcctcacatttatgatgacatcacagtgcacccgtgttcttgtgtgtaggaaatccctcattttggagatgatgcccttcttgggggaaactactagatgagaatattcacatcgtaagtgaatgcaggtgcctatgtgggagactgtggatcagattgtcactgagaaaccaccatccttgccagaacagccttctgggagctcaacctccaagtggcagctatgatttcttttgtttgcagatattagctctctttctctttgcctcttcagctgcatgacctctttttttcaaactgagccagccagtctattttttaaaaaattaagactggcacagtggcttacgcctgtaattccagcattttgggaggtcacggcaggaggatcatttgaggccaggagtttgagaccagcctaggaacatagtgggactccatctctacaaaacatagaaaaaattagctgggtgtggtggtgcacgcctatagccccagctacttgggaggctgaggctgggggatcgcttgagcccaggaggtcgaggctacagtgagctatgatcaggctactgcactctagccagggctacagagtgaaaccccatctctaaaaaaataaaaaataaaatatacaaataataaataaattgtgttgtgttgacacatgaacagaatagactcatatctacatatatgtcatatatgtatgtcattataatagatgcatcttgagttgctgccaaatatggttttttttcagtttggacaaatatttattctcctcgatgattcagctcatctttctattttttagataattgtacattcgcatgcagttctaagaaataatacagtgattttatgcacattttgcccagtttatctccaatcattgactcactgctttttgactagtctgcagctagtgagtcctggtaattctggattggaccacaatgtttgtgattagccttgtgttgacttgtgacattttccttcccttttggctcacaacagcatttaacaacagcagtgcgattttaaatgaacaatttcaatattgcttgtgttgactcttccagagcctcttaattggcaagcttgccttggcatttgggaaggataattaaatattaagtagagggatcccaaataggaatgagcctaagtagtattgtcatgcacattttggtgagatttcatttggcccaaagctcagtaatcagtgcagattgaactggtgtgcctgggtttttctttttacttagagaggcggttccttaccctagccttatctcttgtgtcactccctaggctgggccagcacctgataagcttctgtggaaaatagctgtgttctcggtgtgcaaacaggttctcttgcttgtttctgtcaaagcaatgaactccttccccccaaaaaatgaccttaggaaactcttctttctctacgtattctctgctcatttcctgaagcctgactactttgtcctcatctttgagattcagtatttcttccccccaccacttttatttctttatttattttaaaattttacatagagatggagtctcactatattgaccaggctggtctcaaactcttggcctcaagtgattttcctgcttcagcctcccaaagtgccaggattacaggtgtgaggcatggcaccaggctagattctatatttcaccttgagtcagtcggactaagccgccctctaactcccctcacccctctcctatcggggtgcttcccacccagtctcctgcccttgcctcctaagcgctgatcatgagcctgctgcctgcccacgcatgcactggcactgcctctggctctccctgcttcctaggtctctgtcctagtctgacttctgcacctggtgcacttgcctgctcctggtcactgattctgcttctgcttgtcccaccagtgttagtgtttccaggagttctgactcgggctctcttcacaagacacccacatcctctcctgaggtgttggcattcctctctgtgatgccacctatgactctcccctatggtgagaatgctgggggtttccttttctacaggtctttaaaggctgcagaaatctccctcgagaatactatggcatttaagggaaaaccttcctgaaagcaatgtattcagcctagaaagctgagataacacggtgatctgaaaatgtggagcaaaggacatctgacctagattaaaaaaataattcagagactgatgtgaagtctctgaggtcactttgtaaattcactgaaggaaaattcagagtgtgaaatgtctcctataaacacctggataacacatgggataacacaatgcaaggctttaccatgcacatctcccactggcctgctctgacagcccccttttgagggtaagatgcctggctgaagagcagaatcctcataaaggcagaagaatatttgttatgtatttaattttagatatagggtctcactccgtcacccaggctagaatgcagtgcagatcactgctcattgcagactccaccttctgggctcaagcagtcatcccatctcagcctcctaaagtgttgggattacaggcataagctcagtgccctggagcttctaaaagattcttctgccttggtggggtgcagtggctcatgcctgtaatcctagcactttgggaagctgatgtgggagaattgcttgagcccaggagtttgaaaccagcttgggcaacatagcccatctcaacaaaaaattaaagttaaaaaatttagccaagggctgggcacggtgtctcacatctataattccagcactttgggaggtgggcagatcacttgaggccagaagtttgagaccaacctggccaacatggcgaaaccccgtttctactaaaaatacaaaaattagccaggtgtggtgacgcacacctgtagtcccagctactcgggaggctgaggcacgagaattgcttgaacccggaaggcagaggttgcagtgagccaagattgcgccactgcactccagcctgggtgacagagcaggacctgtctcgaaaaaaaaagaaaaaaagaaaaaagccaggcatggtggtacatgcttgcagtcccagccactcaagaggctgaggcgggaatgagccatagattgtgccactgcactccagcctggatgacagattaaaaaaacacataacaaaacaaaacaaatacacgtcttgaccaccctctaccaccccacacaccgtgtaggtggcaaatatatgaga

SEQ ID NO: 249 - DNA, 50588 bp, Homo sapiens
tgatggttactttttggagtcaacttgactggattgagggacacctagatagctggtaaagcagtgtcttgtgaggctgcttccagaggagactggcgtatgagttggtaggctgagtggggaagacgccctgtcaatatgggagggtaccatccaatcagctgggagcctcggtaggacaaaaaggcagaggaagggcaaatttgctgtctctctcctggagctgggacagccttcttctcctgcccttggacatcagaagtctaagggtcttgacctttagatgctgggacttgcaccagcagccccccaggttctcaggccttcagtctcagactgagtcacaccttcagctcccctggttcagaggctttcagatttgaactgagccatgctcccagcagccccaggtctccaggcggcctgtcgtaggacttctcaggcctccataatcacgtggagccaattcacctaataaatcccttctcatctatctgtctgtctcctatctctatctatctatctatctatctatctatctatctatctatctatctatctatctacctacctacctacctgcatgctataggttctgtctctctggagaaccctaatacggttgggatgcaaattggaaggcacaccacctgttaagtagtcctgctgaaagaatcaatcctaaatcttatcaagacttgagatccaggcggggcgcagtggctcaggcctgtaatcccggcactttgggaggctgaggcaggcagatcacttgaggtcaggagttcaagaccagcctggacaacatggtgagaccccgtctctactaaaatacaaaaattcgctgggcacgttggctcatgcctataatcccagcactttgggaggtggctggatcacctgaggtcaggagttcgagaccagcctggcctactaaaaatacaaaaattagccgggcgtggtggtgtgcatttgtaatcccagctacttgggaggctgaggcaggagaattgcttgaacctggaaggcagaggttgcagtgagccaagatggtgccattgcactccagcctgggtgacaagagcaaagacttcatctcaaaaaaataaaaaataaaaataaaaaaattagggagggcgtggtggctcacgcctgtaatcccagcactttgggaggccgaggtgggcagatcatgaggtcaggagttcaagaccagcctagtcaacatggtgaaaccccgtccctactaaaaatacaaaaattagccaggtgtggtggcgcacacctgtaatcccagctactcggggggctgaggcaggataattgcttgaacccgggaggcaggggttgcagtgagccgagatcgcaccattgcactccatctgtgggcgacagagcaagactccatctcgaaaaaaataataatacaaaattagccgggcatggtggtgtgcgcctgtggtccagatgaggcaggagaatagcctgaacccaggaggtggaggctgcagtgagttgagattgtgccactgcactccagtctggggaacagagtgagaccctgtctcaaaaaaaaaaaaaaagagttcagaacagtgtggatactgtgctgccttttatatgagagcaggaaaaaatatatatatttgcttttgtttattttgcataaagaaacacaagaaactaagcctggtgggagaatgggtgggatgggaaagaggacagtggaaaacagaggtggatagaagcctttcgaatgtgttccttttcatactttttgaatttttgaaatgtgattgtatatagattcattttaattttaaatgtaattaaaatttaaaattcattacggcactactctctcatcctgtactatgggctctacccttttttgtttgtttgtttttgttttgttttgaagagacagagtctcgctgttttccccaggctggtctagaactcctgggctctagcgccccgcctgggcctcccagaatgcgggactacaggcgccgccaccacccggcgtctactctaaatgcatagaggccaggatgacccaaggtcaccagcggccgatgctgcctggcaggggcttgaggccgggaggggaccctgcggacaggcgagaccatgtgtgatctgtgggaagcaactaaaccggcgtattcgcggcaggggagctctgtgccgtcccgcggccccaccccgctctgccatgggaagccgtagcttggcgctgcccacagtgacgcgagggactccgagggcacccgggccggggtggacacgggagtgggcccgggcgcggccggcagggggcagcagcgccgcgccgcccgcgcagttccacaggtgcgccgagcctggggccatcgcctccctccggccgccgtccccagcgaatcgccgcctgcgttctgccgtttccccgccaccgcagccacccggggcccggggggccgcagccatccgcaagccgcggggcggcgggaccgggcgggccgctagggacgccggacgaagggagcccgcgggcggggtctgggcgcctacatccttgctcccagggaggaagggacaggaaactgaagctgtttccggggctgaccccggccagagagagcagggctcgggagagtcggcgcgtcccggaggcggcgccccctggaggccggtgtgctttggctctgcagcgggggagattaggggtggaggccgaccgatcccactcagccaggactggcaggcgccgggagctcactgggaggcaagtgccgacccccgaaacccactccagacaagcgaagaaaacagctctgtgtcccaggacgagcacatacctactgtcacccactgtgcgacctggaagagttactgaccctctctgggccttaatcagtcatcagaaacacaaacgcgtagataagatggtctttaggcctctcccagctctgctattctgtgaatctaagaaactctagtccctccaccagtccccaccccgggctggcttcgcttcagggaggcctggctgagctggggccctcatccaaggtctttgcacggttcctcagcaaaggtgttttggaaggctgggtcccaccccttcccggcggaggaagaggctattggctaaaaagcctggacaaattcaaaaccagcagctcggccccggttttttcggagcacagccaaacccaaatcacacctctgcacctacctagctccagagatctagacagcatttacagcccccaaatgttatttttacaccctttccaggcagggaaggacagaggagggtaagctatttttaggatgactgctatttaaagtaacatactggcctggcaaggtggctctggcctgtaatcccagtgccttgggagatacaggcaggagaatcacgtgaggccatgagttcaatactatcctgggcaacaaaaggagacccccatctctattaaacagccgggcgtggtggtgcgcgtctgtcgtcccaactactggagaggcaggctgaggcgggagggtcccttgagcccaggagttcaagattatagtgagctatgatcacagcactgccctccaggctgggcagtgagaccctgtctcaaaacaataaattaagtaacctagactatgtatgtgaaaataatatttccaaccctagcatgctgacttcatctgagcttacagatgcattttcatacagtcctccccaagggatcagttcctgtgagagccaaggatggcaccactcattgaaatcctgaccatgggaaggcgtcatttgggattccggaatgggtggctgaagcagtttacagaatcgcgttctggtgagctttaagaatggaacaggcgccgggtgcggtggctcacggctgtaatcccagcactttgggaggccgaggcagccagatcacttgaggtcaggaggtcgagatcagcctggccaacatggtgaagccccgactttactaaaaatacaaaaattagccaggtgtgatggcgcgtgcctgtaatcccagctactagggaggctgaggcaggagaatcacttgaactgggatggtggaggttgcagtgagccgagatcatgctactacactccagcctgggcgacagagtgagactcagtctcaaaaaaaaagaaaataaaaagaaacagggacatcttcctgaggaagtctcgggctgctcttcctgaaggtgaggctggttgcatagtctttcaaggtccctcacaagctgaggctcctgtaagttttctcttttcagctagtcttttcaaacgaacacacctccacctcgctttcctccttccaaatgaagagctgatctagagcaggcgcagatccagattttggggcagtcctgaggtttatacatatttgaagggtcttcttaaggaaaaaagaataaaatctgactaacacacatttcctctgaaatggcagcttcgggagcactgctaaggtagccgagccctccattccagtggccacttccagtctaacaattccaccgttttctcttcttttttcaactctttccattccagtggccacttccagtctaacaattccatcgttttctcttcttttttcaactctttccattccagtggccacttccagtctaacaattccatcgttttctcttcttttttcaactctttccctcttcctgcccattttttttatttgttttgttttggatgcttgtttgtttgtttttgagacagagtctcgcccaggctggagtgcagtggcatgatcttggctcactgcaacctccgcctcctgtgtttaagcgattctcctgcctcagcctcttgagtagctgggattacaggtgcccaccaccatgtctggctaattttttttatttttagtagggacggggtttcaccatgttggccaggctggtttcgaactcttgacctcaagtgatccacccgcctcagcctctcaaagtgctaggattgcagggatgagctaccatgcctggccataatattcccattttaatatgcataaattgtatttctgtgtctacacacacacacacacacacacacacacactccagtaacaatgagcacatctagtgcctagatcagggctactaaatattattctctactgaaaggaacagagctccctggagaaatggctgagctcaggcatgacacagggaaagtacaaaatgaaggtagaacattttattgcgtaaggaagaatggccagatgcagtggttcacacctataatcccagcactttgggaggctgaggtgggcagattgcttgagctcaggagtttgagaccagcctgggcaacatggcaaaaccccatctctacaaaaaatacaaaaattagccagacgtggtggtacgtgcttgtagtcccaactactagggagggtgaggtaggaggatctcttgagcctgtggggtcaaggctgcaataagctgtgatggtgccactgtactccagcctgggggatggagcaagaccctgtcacaaaaaaaaaaaaaaaaaggaaaaagtaagaaagttctcaattatagaactttatcagcagccaacttaacagggctcccatggccagatctggaatagtgtaagcatcacaataaatagtgctagtaatggattatagctcattgaatacaacctgaatccctgagtcgtacagctagaaggaaaaaaggggccgggcacagtggctcacgcctataatcccagcactttgggaggccgaggcgtgcggatcgcctgaggtcaggagttcgagaccagcctggccaacatggtgaaaccctatctctaccaaaaatacaaaaattagctaggcgtggtggtaggcgcctgaagtctcagctacttgggaggctgacgcaggagaatcacttgaacctgggaggtggaggttgcagtgagccgagactgcaccattgcactctagcttgggcaacaagagcaaaactctgtctcaaaaaaaaaaaaaaggaaaaaaggaagctgggagggaaggaattgttcttccttgcagcaaaatggcaactaatatggaagaaatggtagaattagaaaatcaccattttggccaggcacagtggatcacgcctataatcccaatgctttgggaggctgaggtgagaggattgcttgagcccaggtgtttgagccatattgggcaacatagtgagactttgtttgtatcaaaaaaaaagttttaattagctggttgcggtgatgcatacctgtagtcccagctacttgagacgctgaggctggaggatttcttgagcccaacaggtcaaagctgcagtgagtcgtgatcataccactgcactctagcctgggtgacagagcgagacccagaaaaagaaaaaaaaaaaaaaaaaaagaaggaaggaaggaaaaaaaaatcaccatttgatggttgtattttccaaaatattttccaacgacttctcttatcctatatattcttttttataatgtgactttgacaatcttctatcaaaagttgggatctctgtctcctccgcttaaaaccaggaggtgttttttgttactgttgggaccaacgaagtatggcagaaataatgccatgtgacttccagaatcttccatttattccgtggaatacttaccccagaagttgaggccaatgggaagaagcccaaactagccataggagagcaccagctgagccctggggctgtgcagagaggtgacccctggcggcccgtcagctccagctctgcctccactgtgacaaggacctcatgagagacccagagcagaactgtccagctgggctctgcccaaacccctgacccacagacactgggagagatcataaatttgtttgtttgttttgggtttggttttgaaatggagtttcactcttgttgtccaggctggagtgcaatggcaccatctcggctcactgcaacctccgcctcccgggttcaagctattctcctgcctcagcctcccaagtagctaggattacaggcgtgcgccaccatgcctggctaatcttgtatttttagtagagacggggtttccccatgttggtcaggctggtctcaaacttctgacctcaggtgatccgcccgcctcggcctcccaaagtgctgggattaaagatgtgagccaccacgcctggccccataaatttttatttttgtttcaaaccactacgttttgggataatttgctacacagcaataaacggaacagcaaccatgatagtaatagcagatttagacaaaagtcctcagtggatgcaagcactaatgggtaaagttttaaggaggagtgaagacttttacataaagtgtctcctctccaaatatgtgttaattactaagggaaaaatggtaacttcgcaatggcaaattctggcagaaatcaacttaagcgatcaaagtcagtatcatattgagacaaattaacattgtatgcatcagtatgctggcaaatgtgtaacagctggctggtggggacatggatttgtaacatttgctgatttttgtggcacaaaaactcccacaagcctggtgtcgtggctcatgcctgtaatcccagcactttgggaagccgaggcgggaggatggattgaggccaggagtttgagacaggctagacagtatagcatgatcccatctctacaaaaagtaaaaagaaagaaaacttagccgaggtggcggtgcacgcctgtagtcccaactactttggatgctgggcaggaggattgcttgagcccaggaggtagtggctacaatgaacagcgatcctgccactgcactctagcctaggcaatggagtgagacccctgtctcaaaaaaaaaaaaaaaaaaattcccatcaagaccaattccagactcctaaaggtttaacaacaagctggaagtataacacttggccccattcatgtgcccctggtgtgtacactgagaaggacaaagcctcgctgccaaggtgctcctctcaaaaaggtatcccctgagcctcttcctagggaaacattagatgaacctgaaatgagggatagtctatgaagtaactggcctgtactcttcaaaaatgaggttccaaaacacaaaggaagactaagaagctatttcagactgaaagagactagagagttgacagctaaatgtaacttgtgatcctggattgggttctggaccaagaacaaaacaaaacaaagctcagcagggccagagccagatactagcgtcttttcaatgttaatacttttctgatttgattggatgtactgtggctccataggagaatgtcactgtctttaggaaatgtgcactggagaatctaggaataaaaggcataatatctgcaacttagtctcgagtggttaaaaaaaataggatatatagagagagcaattagaaacagagaaagaatgatatatggaatcaaatgttgtaaaatgttaataactgggggaacctgggcaaagagaatgttagaggtttgtgttgttgttgttgttatttttgtttgtttttttgagacagggtctcgctttattggccaggctggagtggagtggtgtgatctcagttcactacaacctcctcttcctgggctcaagcaatcctcccacctcagccttctgaatagctaggaccacaggcacaccccaccatgcccagctaatttttgtatttttagtagagatgaggtctggccatgttgcccaagctggtctcaaactcctgggctcaagcaatccactcgcctcggcctctcaaagtgctgggatgacaggcgtgaccccctgtgcctggcctggtaagagttttttgtactattcttgcaactttttgaaattatttcaaaatgatcagataaatgctccatggacatttagttcaataggactaggcctatgcaatgaggaataaagtcaagaaggaagaactaacaagctttgtaagttgaatttaaaagcttaaagactggatgtggtggctagtgcctgtaatcccaggtatccaggaggctgaggcaggaggataacttgaggccatagtttgagatcagttgatcagcctgagcaacatagtgagacactgtctccaaaaaaaaaaaaaaaaaaaaaaaaggccgggtgtggcagctcacacctgtaatcccagcactttgggaggccgaggcgggcagatcatgaggtcaggagttcaagaccagcctagccaacacagtgaaaccccgtctctactaaaaatacaaaaattagccaggcgtgatggcaggtgcctgtaaacccagctactcgagaggctgaggcagaagaattgcttgaacccgggaggcagaggttgcagttagccaaggtcgcgccactgccctccagcctgggcaacagacactctgtctcaaaaaaaaaaaaaaaaaaaaaaaaagaaggaagaactggacacaaagcacaaaggcaagactattgctggttcattttgccaaatcagagatcacagcaagtccaggccagaggctgtttgcgtctgcctgtgttggaggtcccctgcgcagttgggacctaaaagatcttcagggattgggtaaggcactgaatcacctgcagagttagacaggaccctagaggttgtcttcttccatccaggcacagcttatggttgctgttttttcccagttccaggaaccaaatggtgataaactaggaatggagagagggcttgctgctgtctgagagctcaggtacaggtcatggaagatggatgagaggacattcgcctggggcttttgaggaattctttgattccctgccatccttgagttgggtgaggacagaggtggcttcttgcatccttcttccaaggccaggtgaggagctggactctgatcacatgaggtcttttatttggggcggctctgctctactcccctctgccttggcagctggctgaacagacacagtgacagccactcattcaatgcattgtttattgagtactaactagctttgggcccaggctctgggttagcagcatgcgtgaaacaatcagaaacaatcatgagcgcctgcccacatggggcatacagtctggcagggcaagactgtagacacagaaataaatatccgattataagctgtgattagaggcatgatggaaaagagcaaggcttcctgagagaaacagggcgagcacaggaaaacctctctgagacagtgacatgaacttgaaacttgaagggtaaacaggagtgggcaagacaaaaggggaaagaaggaatcttccaggcagagagaaagagaaaagacccaggcacggtatagagccgaggacatttgaggaagaaagggccgccggggttggggccctctgggtgactgggagaggaaggcgccggaatggatccagattaaatcggatgctgtatgccctgtggagacatggggtgtacctctaaacgcactgcgttgtaagcaaaggagtgacctgatttaatttgatcttttaaaagtcattctaggccaggccgggtggctcacgcctgtaatcccagtgctttgggaggccgaggcgggtggaccacgaggtcaggtgttcgagaccagcctggccaacatagtgaaaccccatctctactaaaaatacaaaaattatccgggcatggtggtgcatgcctgtaatcccagctactcaggaggctgaggcacgagaatccgcttgaacccgggaggtggaggttgcagtgagccgagatcgcaccgctgcactccaccctgggcaacagagcgagactccatctcaaacaaaacaaaacaaacaaacaaaatgtcattctacactgtgaaaaatgagctggaggaggcaaagggaagaaaggggagatcagtgaggaggctgttgtcatagctcaggcaggagtatggtagcttggacttggcaacagcgtgcaggtagagcaccaccgctggagtctggatgcgggatgcattctgatgtagggagtgggggaccgcgcagcatcaagaagccaccgctggagtccagatgagggatgcgttctgatgtagggagtgggggacggcgcagcatcaagacttgcactgaaaatttctgctttgagcaactgcgtggaatggatggaggtgtccttcaccagctatgggaaaggccagggaaaggtttaaagggctgagtgtggtggctcatgtcagtaatcccagcacttcgggagactgcggcaggaggatcacttgagttggagaccagcctgggcaacatagcaagacactctttagaaaaattaaagtagagaaaaagaaaggtttaaagggaagagactgagggttcagaattgtacctcatcagtttctgagattcctgtgagctctccaagtgcataaataaatgtgggaatcattaacaaataaatggtatgaaaaagcaaaggaatggatgagaccacccaggaaaagtgtacagagagagaagagaaataaagaggagagagttaaagagaccagaataggccaggcatggtggctaatgcctgtaattccagcactttgggagccaaggggcgagtggatcacctgaggtcaagagttggataccagcctcgccaacatggtgaaaacctgtctctactaaaaatgcaaaaatcagctgggtgtggtggcacatgcctataattccaactactcgcgaggctgatgcaagagaattgcctgaacccgggtggcggaggttgcactgagctgagatcgcaccattgtactccagcctgggcaacaagagcaaaactccatctcgaaaaaatacaaaaataaaaaaataaagagaccagaatagaagagagcccaggactgagtcctgaggaaacagcacagagatcagagagaggagaagactctgaaatagggaaactggaagaaatggccagagacaggagaaaaccaagagggtcaatgtcactgtggctgagagagaatatttccagaggatgaatttgctcagccagccaagtgcttctcacagggtcgctccatacagaggccattgatttcatgggcacatggagctgattcaagaacgagtgagaggaagtgacagcgtgtgcaagaagacagcttgtagagggctggctagcttctcctcactttgtagccacatctgctatgaacttatcccatctcttcttccagatttccatgaaagtatttttctcactctccaacagggtactgtacctgcaggaagaggaggagcccaggtcagcctcagggcaggggttggggaacggggcagggagcctgagaggacattagagccttgcagagcactctccccaggccagcagcaaggactaaacagccatgatgagaaggaacccacaggaaccatcgaggcatctgcctcaagcctccagagaggcaaacacaagctgcgggctggaaggaggcgggggacctgggaggacacaggacactcacttgatagagttcatggccagctgtttgagggtcctcaggtcagccttcatccccccaatgcccatgaagacctcatagaaatcataggacaagcctttggcaccaaacatagctgggtcatcagagctgatcaccatggggtgcccagtggccatcagagtggctacagggtggttcctcaagtcagacaccagtttcagcacctgcgcaataggagggaagggagaaagatgaactctgatccctaaaaagagtagtcacaagtgaggtgagaccttgagccccatcagctcccttcatcttcccatcactatctccccagtatggggatgacttctgggcagagtcacaaggagacataaggaacagagccagtccttatgctcctcctcatgtttcatcagcactgcaaacatcgggtcacttctgttcctgctcagagaagcgctaactgaacacagacacaaaggaccccaagaaaccatggggagcagcatcccatggtccgtcccacttcactggcctccccccatgtcctttttgctttgtctacagtcttgcccaaaattccaccccactggggaccctcactgctgcctcattcttattggtggcttaggcaaaaggcccctcctgaataactttactaacaggggtaggagagtggagggatgtaggtaacaagagagttaaggagagataagttatacagcaaaaagtttaagagagcagaggttgtggttaggggagatcatatgggattagccacatgggtcacacatacctggttagagatgggacagacttctatggggatgtcctttttccaggagtaagtcctgactgcggggtgtttgctcaaagcaaatccatggccgattctggtagtgttcagcatcagagcatccagaatgttcctgtctatggaagtaccctgccagtctgaacacacgggaatggtcttccatgggggatggatgggtctggtcttccatgggggatggatgggtctgacccacccgccccccgaccatcctcaaataaacagccccccaagcacaaaaatgaagagaaattaacattaacacaaatacacacacacagtttccttttaacaatgctaaagagaggtatgatatggctttattaaattaatcatctaatttattaatttatcattctaatgagaaagttgaaacttaatagcttctataaattgaccaaggatgttcacacagtaagtagcaaaaccgagttttttgttgttgttgttgttgttttttgagacacagtcttgctctgtcgccaggctggagtacagtggcacgatctcagctcactgcaacctccacctcccaggttcaaacaattttcctgcctcagcctcctgagtagctgggactacgggcacacgccaccacgcccagataattttttgtatttttagtagagacagggtttcaccatgttggccaggatggtcttgatttcttgacctcgtgatccacctgcctcagcctcccaaagtgctgggattacaggcgtgagccgccgcacctggcctgcaaaactgagttttaaaccttcgtctctctgaccccacagtccgctttccttcttcctcttttgtggcactcttttttttttttttttttttttgagacggagtcttgctctgtcgcccaggctggaatgcagtggcgtaatcttggctcactgcaacctccgcctcccgggttcaagcggattctcctgcctcagcctcctgagtagctgggattacaggtgcccaccaccatgcccggctattttttgtatttttagtagagacggggtttcaccatgtcggccaggccggtctcaaactcctgacctcaggggatccacccgcctaggcctcccaaagtgctgtgattataggcatgagccaccgcaccgggctctgggactcttatgcttatgatctttacaacaatatgttacaggttctcttattgacaacatcagtataactacctgtatgtgctcactttaatttatatatttaatagtactgtcaagatgttatcactcgctagatgaccgcagacagtcttgtggcctcccttctcccctgccatccccatcacacctttctttttttttttttttttttttgagatggagtctcgctctgtcacccaggctggagtgcagtggtgcagtctcggctcactgcaagctccacttcccggggttcatgccattctcctgcctcagcctcccaagtagctgggactacaggcgcccgccaccacacccagctgatttttttttttgtatttttagtagagacagggtttcactgtgttagccaggatggtctcgatcacctgaccttgtgatccacctgcctcagcctcccaaagtgctgggattacaggcgtgagccaccacgcccggccccatcacacctttcttgcagctagggccctcggtagaggatgaaaggtcagatgtgcctttctcagtctcccttacagctaaaatagccttaacgctggactgggaggttatttgttggggagctttgggggattcctccctgataaaaggggatccactgggaggctgtctcctattttgcttcactggatgtggtcaccccaaatgtgattcaccatccgacaaccaagtggggcagaatcacccacacaatgggcatagcacagattgcttcttacgtgagataacaaatgtccttattgtaaaatcggtgggatgcatgtactctattcttgcagccataagcattctaatggattcacatataaaatatgaacatctggctgggtgcggtggctcacacctgtaatcgcagcactttgggaggctgaggcaggaggattgcttgagcccaggagttcaaggccagccatgggcaacatagagacaccctgtctctacaaaaaatacaaaaattagccaggcatggtggcatgtggctgcagtcccagctacttaggaggctgaggtggaaggataacctgaacccaggaggtggaggctgtagtgagctgtgatcacgccaccacactctagcctgggtgacagaggtggaggctgtagtgagctgtcatcacaccaccgcactctagcctgggtgacagagtgcccatgtcaaaatatatatatatatatatatatatgaaaactccactttcctgatagaaataaaactcaagaatttccattgctatgtagcacatgtgttttggtggattttcactggtttttaaagatttctttttctttttaaaaataaggatattggccgggtgtggtggctcacacctgtaatcccaccactttgggaggccgaggtgggcggatcacgaggttaggagttccggaccagcatgaccaacatggtgaaaccccgtctctactaaaaatacaaaaaatattagccgggcgtggtggcaggcgcccgagtagtcccagctactcgggaggctgaggcaggagaatggcgtgaacctgggaggcggagcttgcagtgagttgagatcgtgccactgcactccagcctggggacagagcgagactccgtctcaaaaaataaaataaaataaaataaaataaaataaaaaaataaaaataaggacattacttttaggtattagatacccaagtcctggcaaaatcatctccaaggaccatacatcttggaacctgttaggtcctgagctgcaatgttttgtagggccagaattatttcacacacataagtatgattttccccaaccagaccacaagctcttcaaggttaacaacaccctcgcccaaccccctccccctcaaacaattcttctgctctcctagagcagactttgatctaaattggatctaaattgactcgaaatgtcaggaaaaagagattaatgcacaaggtccctttctctgagagaaggtgtgatagagcagagcttaagcctgggtgggaaatgaaattgcccaccactctctccacccctctttggtcttccgagggtgacaggtgggatgctgaagagagctgccctcctggtcccggcctccatgtgaacagcctcctcccaaatcttcctttggatctgaaattgcagccgtgatctttcttagttagggtttacacattttaaggactggaatacgggaggggctgagatgactgagcgagcccaaggatggagttctgggaaagaaagatgtggctgggctgatggcgtttcaggaggaacagcagccagggcctgcatggggcagggcagggtttcctctcctacgataatgcgggacagaacatcctaaagacaaggagcagacctggttctcctccctcttctgccaatttccagctgtgtggctttaggcagatcagttaacctctcaagcacaattcactcggaggatggagagcgtcagaaagtgttccaattcatacacattatatacaggcatcaaaatatcacatgaggccgggtaatcccagcactttgggaggccaaggcgggtggattgtttgaggttgggagttcaagaccagcctgggccaacatggtgaaaccctatccctattaaaaatacaaaaattagccgggtgtgttggtgggcgcctgtaatcccagctactcgggaggctgaggcacgagaatcacttgaacctggcagccagaggttgcagtgagccgagatcgcaccactgcactccagcctgggcgatacagtaagactctgtctcaaaagaatttttttccgtggctcaagcctgtaatcccagcattttgggaggctgaggtgggtggatcacttgaggtcaggagttcaagaccagcctaaccaacatggtgaaaccccatctctactaaaaatacaaaaattagctaggcatggtggtgcatgcccgtaatcccagcttctccagaggctgaggcagaagaatcacttgaacccgggaggcagaggttgcagtgagccaagatcgcaccactgcactccagcctgggtgacagagtgagactccatctcaaaaaacaaaaaaattgaccaggtgcagtggctcacacctgtaatcccagcactttgggaggcctagacgggtggatcacaaggtcaggcgatcgagaccatcctggctaacacagtgaaacctcgtctctactaaaaatacaaaaaattagccgggcgtggtggcgggcacctgtagtcccagctacttgggaggctgaggcaggagaatggcatgaacccaggaagccgagcttgcaagtgagccgagatcataccactgcactccagcctgggccacagagcgagactccatctcaaaaaaaaaaaaaaaaaatttgttttcctttttgtgtagaatggaatcttactatgttgcccagactggtctcaaactcctgggctcaagtgatcctcctgcctctgcctccctaagtgctagaattacagatgtgagccactgtacctggctaaaacacttttttttttgagacagggtctagctctgtcacccaggctggagttcagtgagcctgggctcaggcaatcctcccacctcagcctctaagtaggtgggaccacaggtgtgtaccatcatgcctggctaatttttgtatttttttgtagagacaaagttttgccatgttgccctggctggcctcaaactcctgggtttaaagagatccacccacatcagcctccaaagtgctaggattacaggcatgagccactgtgcctgtgcccagcctaaaacgaatttttatagccaaagtaggatgatgtgagtttgcaggattatgcccctaccacgaaaaattaaaaaaaaaaaaaaaaagaagaagaagaaggattcaaattcagactccactgcgcaccagctctttaaccctggaccactgtgtttggagccttgggctcttcatctatcaaatggagattaaaaactggggaaacaatcagaaatcaattagaaaaggccaggcgcagtggctcacccttgtaattccagcactttgggaggccgaggagggcagatcatgaggtcaggagatcaagaccatcctggctaacacggtgaaaccccgtctctactaaaaatacaaaaaattagccaggcgtggtggcaggtgcctgtagtaccagctacttggaaggctgaggcaggagactctcttgaacctgggaagccgaggttgcagtgagctgggcgacagagggagactccgtaaaaaaaagaaaaaaaaagaagaagaagaaaagaaaacaggaaggaaagaagaaagagaaactagaaataatacatgtaaagtggctgattctattatccttgttattccttctccatggggctgttgtcaggattaagtgagatagagcacaggaaagggctctggaaacgcctgtaggctctaaccctgaggcatgggcctgtggccaggagctctcccattgaccacctccgctgcctctgctcgcatcccgcaggctcacctgtttctccggcgtggaagaagtaaggcagcttaacgccatccttggcggggatcatcagagcttccttgtagtcatgcaaggagtggccagtgtcctcatgccccacctgcaggacagagagggacagggaggtgtctgcagggcgcatgcctcacttgctgatggcgcgccctggagcctgtgcacacccttccttgtaccctgccaccactgccgggacctttgtcacacagccttttaagaatgaccaggagcaggccaggcgtggtggctcacacctgtaatcccagcactttgggaggccgaggcaggcagatcacgaagtcaggagatcgagaccatcctggctaacacagtgaaaccccatctctactaaaaatacaaaaaattatccaggtgtggtagcgggtgcctgtagtcccagctacttgggaggctgaggcaggagaatggcatgaacccaggaggcagaacttgcagtgagctgagatcacaccaatgcactacagcctggccaagagcaaaaaatatatatatatatatattttgtaaagacggggtctcaccgatttgctcaggctggtctagaactcctggactcaggtgaccctcccaccttggccccccaaggtgctgggattacaggagtgagccactgccctggactaatctagattcttttttttttttttttttgagatggagtcttgctctgtcgcccaggctggagtgcaatggtgcaatctcagctcactgcaacctctgcctcctgagttcaagtgattctgcctcagcctcccaagtagctgggattacaggtgcaggccaccaaggctggctaatttttgtgtttttagtagagatgcggtttctccatgttggccaggctggtcttgaacttcagacctcaggtgatccacctgtctcgccctcccaaagtgctgagggcatgagccactgcacccggcctagattctttatgagattgccgagctgtcacctaagaaatgtcctggttgtgcttcgatttggtggggaggtgtgggacaatgacaacacctatgaatgtgtagcttcaaaaactggtgtggccaggcatgatggctggagagggagggacaaatatcactaccttgaggatttgcaaaggcctggctccatcctggactctgtttccagacattaccccccagtccccaccccgcgtgctacaggggctggtgagggttttaagacccacacctaggtgagcagtgtgggatagaaaaaagggcacaggcagggccatggggaatgagcccataactgtggtccaaactccctgaatgccatccttattctggaactttccttgttagcttgttagaactggctgtctgctctcccttctccagtgacagccgtcccctgtaggcctctgaagagggtcagcgctgagctctgagcagccctgctgtgtcagcagcctgagcctgccctgggatgtcagggtaccaacaggcacattgcgctcccttcccagggagttgccgctccacccagacaggcatcctcgcatgcccccttaacaggcagcccttctgttcacagcatgggttaccaggtcaaaccctgccaccaccgtggggaacttgattcggagccccatggccattcggatggattctgcgatgacagccacatctttggatctgtgagacagacagagaagccaggagacagtgcccagcaccgacagagcacaaaccccagagcacaccctccgtgcagggctgggccagccccaagtgtgcaggtcccgtttcccaaacctgaggcacccctgccctcctgaccccaccctgaccaggccattgtgatccctgagagatatgtagcccaaatccattcttatcaaagacccttgctggctctgggggcacctgtagtctctgaaaagtagatggggtcagaggacccacgggaacagttttatttgtctgcgtttagaggaggccaggtggccttgttcccagctctccctgcatctctgtcgggggtgtagacatggatgcagctcaggggcagctctctgtccactgcacacctgcaaagggccacaggtcacccaagtccctgatgggtcggctggacccagtaaccatatggcctcttgctgattaagtcagcaagatcctgggtactgcagaaccctacaggggcaaggcaggcagcatgacaacaaaagccccaaaacacagggtctggcgcaagcccacgacaggctcaaggtctttgccctgccactggctctcctgctccaatcctcggctctgtggggataaagccttcctggcctgccccacccatggcctctccccagagcctaggcaaacctgggggcactgatgcactcagctcagccctcacaccctcctgccactggccctgggaaggggcacctggcaccagggagcctctgagcagaacgtgggcccatcctgcaagctccctcctagggggaccggcacaaagccagagcttagctcctccaggccccaggccccatggaagggaaggggactcaggaagactgggcatgggaggaggctcctggggagtcagtgccctccagagcccaggctcgtgggtgagctgagcagagggagccgctgccggatcccttcggtgcccgccccgtgcctgactccgagggaccccactggctgctgcccttgcagctgcgaccatggacaggtcccagccttagactggctgctctttaaagtgaggggaggggtcttgtctggtaaagtcagaaggacaattaagctgcaaagctttctgtgcttccctgggaaaaagagtgggtctttcacccacgtgccaggccacgcacatggtactactggaggtccccacacgcagacttgagccagtgccactcagggtgtctccgtgatcaaggactcacacacaaccacacacagaacccagaggcaaattgaaaccaaaaacgggccaattatccaaacattcaggcaaaaccattatgctcataaatgagtcaccaggccaatgtggggtcacagccgagaattatctgggaaattcacacattcttcatttcagtttgggggtgaagacctgaactagaagtggcttcaggcagcaattcattgttgggtcaccgcacttacctaggactgtgctctcacacaggcacagcacagctccttggcaccagtgctgggcctctcccggcctcccagccccgcttctcacccctcccctcccagcctagtagctctgcctgcatcccagcctcccaacccgagcttttcagcaatattctctctcacctgtgatccgaataaatgattttgattccaataaactcagggtgagtttccacaaacttctgagctacttcctggtaagtcttcactgaccactcttcgtcatggtgctctccactgagctcatacacctgggaagaaagcacaaccaggagccgtcaggtgagcagtgagagacgccacccccttcccagccacccctgcccagccacccctggccagccacccctgcccaaccacccccttcccagccaccccttcccagccacccttgcccagccacccctgcccagccacccttgcccagccacctccttcccagtcaactccttcccagccatcaacgagctctgggaaaagtagatggggtcaggggacccacaaaacagttttatttgtgtttggattaggccaagtggccttgttcccaaaagtccagccaggctggacttgtgcttcccttgttcaggtcctctacggccttgggcattgtctctgctgctgcatggggaattcctagctggctctgggataaccctgatgctgatgcccacctgtctccttcattgctgggtcactgcacttaaaacagcacatggcacacgcgagggtaggtgcccattaagcatctgcataatggttgaagagcaggtcacggggggagaggatgaaagctagaaagagtgatctgagaatgacgtcattccccactacctgctcacctccccactgcttccctaactccaggtgcagcagctgcaaggcggccactgccaccagggacagcaagggggacacagtgagagcagagtggggagagttgggagtgggcaggtgacaaggaagctaagggaagggaggtgtgtaatggggaaaggtggctcacacctgtaatcatagcactttgggaggccgaggcagggggatcacttgaggtcaggagttcaagaccagcctggccaacatggtgaaacccccatctctaccaaaaatacaagattagctgggcatggtggcacatgcctgttaatctcagctactggggaggctgaggcaggagaatcgcttgaacccgggaggcagaggttgcagtgagccaagatcataccactgcactccagcctgggcgacaaagcaagactctgtctcgaaaaaaaaaaagggggggccctctctcttcctcggcgctgcctacagaagtggcagccatctcctctttggcatcatggccaccctcagaccccttgtgaagcctgattgtcaaaaagagaaccaaaaagttcatctggcaccggtctgaccaatacgtcaaaattaaccgtaactggcggaaacccagaggtattcacaacggggttcatagaaggttcaagggccagatctcgatgcccaacagtggttatgggagcaacaaaaaaaaacaaagaacacgctgcccagtggcttccagaagttcctggtccacaacatcaaggagctggaagtgctgctgatgtgcaacaatctccctgtgctgacatcgctcacaacgtttcctctaagaaccacgaagccatcgtggaaagagctgcccagctggtcatcagagtcaccaaccccaatgccaggctgcgcagcaaagaaaatgagtagacagctcatgtcccctttttgtgtttaaataaaaccgtaaaaactgcaaaaaaaaaaaaaaaaaaaaaaaaaaaggacagcgcggtggctcacgcctgtaatcccagcactttgggcggtcgaggtgggtggatcacgaggtcatgagttcgagaccagcctggccaatatggtgaaacctcgtctctactaaaaatacaaaaattagccgggtgtggtggtgcgtgcctgtagtagtcccagccactcgggaggctgaggcaggataatcgcttgaacccaggaggcagaggttgctgtgagccaagatcgcgccattgcactccagcctgggtgacagagcgagactccaccttaaaaaaaaactaaaaaaaaaaaaaaaagatgtgggaatttctgcagagactgtggggtgaaggagacagggagcaataatatggagatgtcgattacttccatggcatcagttaagcccttatgatataaaaggaacagggctgggcattggaagggatgaaaaaatgctaatagacaagatagctgccctcaggagtgacaatagggtcagagagatagacctgacccactaaaaagagctcacgcctgtaatcccagcactttgggaggccgaggcaggaggatcacttgagcccaggaggtcaagaccagcctgggcaatgagtgagttcctgtctgtaaaaaggaatgaaaaaaaaaaaaaaaagaaacaatagaataagtgctaaagagaagcacatgacctctcaaaagaagaagcagtttgttgtgactggatgggtcagagaaggttgctagtcctgaccaagggaatggtggctccacacagagtcaagagctgcctgggggcgggggttcaaggagccgaggttgagagctgcagtgggagccaggagctgtcccctcactaagggagaaatgcccttcctcctcccgggagtcggctcttgcctctgtggcatctcaggaaatgggcccttgggagtccacctcctctgctcatttcccaccagccccttgcctcactcctgtctccccagcctaggggcctcccacacccctccaggctgcggccattgtgtgtcctttgtctctgggcagtccctcagatccccgcattcccccaggcctgcagaacagtactgctgctctctcatctccagggtgctgccccgctgcctgggcaggcgcagtgggggagcaggcagtgaggctctccactggtctttgctcttctgtttcctctgctgcccccatgaagcctggcacgtcacacagccccccacaacctgcacctggccaggccactcactctgctcgggcagtttccctgactgcctgacctggcacagccatgctcaggggctactgaactttaaggctgccagagcgtgccagaaggaagaaccttaggtactgttcattcaggatctagtattgtctattattattattatttactgaagagggtcagaatatgtcacccaataggccactttagcagaagaaatatttttagctgaaggcaattaagaagcagcaaatgaagaaagagctctttgcccacctcatctgcctaaatttccctttgtgaaggtgtcgccctcccctctcccgtaccaggagaatcacccttaccaccggaaacagaaagttgttaccaagatgggtctgcacaaaccagccttataaaattgcccttatcttccattagtttcccccatatgtttgcctgcccacaatttactgtccctagaagcccaaaccccttttccttcatcttgtcacttcttcacaatttattaccagttgttaaaatggaatataagccctcactctaacttctttggtgcttcacgtcttttcaaggaaggcctgcatctatctgtgcacatagcaaattcttaggccgggtgtgatggctcatgcctgtaatcccagcactttgggaggcggaggcagatcacctcgggcaaatcacctgaggtcaggagttggagactatcctggccaacatggtgaaacctcatctctactaaaaatacaacaattagccgggcgtggtggtgggcgcctgtaatcccagctactggggaggctgaggcaggagaatcgcttgaacccgggagttggaggttgcagtgagctgagatcgcgccactgcactccagcctgggcgacagagcaagactccgtctcaaaaaaaaacaaaacaaaacaaaaaaatttttttaaacttttattttgcaacagtcttgccgtgtcgtccaggctggagtgtggtggtgcaatcttggttcactgtctgtttcactcttattctctcatggatgtacagtagaattttcctgaagctgcatcatgtgtcatatcattctgaccgataatgccaatcatggattatgtgtttgtatttagaataatttctttcctttttttttttttttttgagacggagtctcgctctgtcacccaggctggagtgcagtggtgcgatctcggctcactttaacctccacctcctgggttcaagcacgactcccgagtagctgggattacaggcacatgccaccacgcctggctatttttttgtatttctggtagagacggggtttcgccatgctggtcaggctggtcttgaactcctgacctcatgatctgctcgcctcagcctcccaaagcgctgggattacaggcatgagccactgcgcccggcaagaaaatttcttaattttggctgggtgcaatagctcacacctgtaatcccagcactttggggggccaaggcgagtggatcacctgatgtcagttgaccagcctggccaacatggtgaaaccccttctctactaaaaatacaaaaatttgctgtaatcccagctactcgggaggctgatgcaggagaatcacttgaacccaggaagcggaggttgcagtgagccaagattgtgtgccattgtactccagcctaggcaacaaaagtgaaactccatcccaaaaaaaaaaaaaaaaaggaaaatttcttaattttaacatctaatacaggatatatcaatagatataatccacataaataaaaggcgtttgaaattaacaaaaatttttaagaatataaagaggttctgggaccagaaagttggagaaccactgtgttaacccaacccacaattgttacctgcagttgtcttggactcatccagctggttcacagcagggaagaatagggttctgtcctgaccttgaccaccctgtcattactgagtctcctgcccacaccccccagctagattggaggctcctccagggtagagtccttgcagttttactctccccacctcctctcctatggcaccagagcaggagctccataaataaatattaattcaaggagagtgctgtccacaggagttttaaaagtactaaggcccaggcagcaagggcaaatagacagttgttggcggagtggtaggtggagtcatgccagcagaatagaagggagaccaaagaaataacctttaaaaaatattaacaaatgacaactctgcttaaaagaagatctctgaggcctggcatggtggcttatgcctgtaatcccagcactttaggaggccgaggcaggcgaatcacctgaggtcaggagttcaagagcagcctggccaacatggcgaaaccccgtctctactaaaaatacaaaaattagccgggcatggtgatgggcacctgtaatcccaactactcgggaggctgaggcaggagaatcacttgaacccaggaggcagaggttgcagtgagccaagatcgcaccactgcactccagcctggacgacagattggttcatggggaaatttgggagcagagtgctgtaaaggtcatacaactggtttgtatcagaacagaaacaaggactcgcaatttctttttttctttctttcttttttttcttttttttttttgtctgagacagggtctcactctgcggcccaggctgcagtgcagtggcatgatcttgaacagccttgaatttccaggctcaggtgatcctcccacctcagcctcttgagtaactgggaccacaggtgcataccaccatacctggctaattattttgttttgtcctgttttgtagagacaagggttttgccatgttgcctaggctggtctcgaactcctgagctcaagggattcacctgccaccatctcccaaagtgctgggactacaggcatgagccactgcacctggccagtactggcagtttcactcagctttcactaccagagtatcattcacttaagaagtgttgagcttctactacatgccaggcatatgcagggggctttatgccataatctcatttaaccctcaaaactacactatgaggtaggtctcattttacagataaggattttgaggctttaaaagtttgagaaggctgagcacggtggctcacgcctataatcctagcactttgggaggccaaggcgggcggatcacctgaggtcacgaattcgagaccagcctgaccaacatggagaaaccccgtctctactaaaaatagaaaattagccgggtgtggtggcacatgcctgtattcccagctactcgggaggctgaggcaggagaatcgcttgaacccgggaggcggaggttgcggtgagccaagattgcaccattgcactccagtctgggcaacaagaacgaaactccgtctcaaaaaaaaaaaaaacaaaaaaattgagaaactcagtacccctgcataattagtggggctggaggccgaccacatttcagaattttgcttgccctgagttgtctcctgtcatcaggaggcccctgccccctcctgtagaaaggtgacagtcactagagtgacatctcagccctggcggcacattggcatcactcaaggagaggaaaaatgcctgtgtcccaccccagagcaaccaaatcagaatctgtggggtagaagcttggtgtttgtaatctcccaggtggtgctagggtgcgatatacagctgggctgaagatctgccactgttccaatcgacagacaagtaaatagcacaatgacagcatagtcggatgagtcctgtcaaaaagggagcagttaagagggtgcgtgttctcgtaaagcgacaccagcaacatgacacagggttcgcttcattcagcaaggagccaaatggaattttgaatgaaaggtctgctaagaatccaggcaaaagcatgggggctggggagcgcgggtacagggagcactagaaatgcttactgtatgaacgacaacgtcttagaaaacgtctgggaacgactgtcacaggttctctgccaccgacgtgtctcccataagctctcccctccataagtgccagcagggccatcccctgtggataaccctccggggtcttggaagagccccatgctaaagactcaggggacccagtctgggcctcagactctgccgtgggggaaggggccggagcccaggagataagacccgcctagcgaccgttgctaccggcgagcagcctttgttactgagcattaggaacacaatgggaggctcagcggccaggatagtccgtccacagcagcccaggccggaattagcctgcgaccaggcagggggaggcgagggggctcagcaaaaggattctagtgaagactgtttttagttgttaatgtgttggtggccccccaactctggctaatggggggcattaagacctagactctccgtggcaaaagcctttgttccagggtcagacccgaacaaatgggcacatcccctccccctccccctccaccagaatcccaaatcctagcagcccagcaccttctccaaaggttggctgggggacgggcggagacgggcagagtgaggacagaggactggagctgggcaggcccccaagtctctccacctccggctctggaaggagaaaatggccacctgcagaacaagggggaagatggaacaggaagccagtgctctggcccttctcttcctccctccgatccaaccgctcagcaacttctcccacatgcctccccaccaggctcaagatgaaagcctctgtctcagcgtctcctccctcccctcctctatcctcttcccctccacccacgaagatcccagggttctgcgagggtcggagttccctatgcactcccacaccaagacagttgtcaggatttgcccaacaggaagttctcccctaccagagcccagttccattccagggaatccatctcccctccggaaaaaggaaaattgaagccagatgctctctgggatcgccatttgaggtgggcgtggctattaggacgctcagagagcccagcgcggtgaggaaagcgacgaacttaggagccctggtctgggtccagccaccccttactacctatttgaccttcatcaagctctttgacctttccaggctttagtttcgacatcaataagatgaattaatagctgggcatggctcgcgtctgtaatcctagtactttgggaggccgacgtgggtgtatttgcctgagctcaggagttccagaccagcctgggcaatatggtaaaaccccatctcgccaggcgcggtggctcacgcctgtaatcccagcactttgggatgccaaggtgggtggatcacttgaggtcgtgagttcgaaaccagcctggccaatatggtgaaatctcatctcttctaaaaatacaaaaattagctgagtgcggtggtgtacacctgtaatcccagctactcgggaggctgaggcaggagaatcacttgaatccgggaggcggaggttacaatgcgccaagatcacgccactttactccagcctgggcaacacagaatgtctcaaaaacaacaaacaaacaaacacaagaatcacctgctctgggaagtgcagtttcttccagcctacctaggccaggagcaaagtcagctcatcaatttttgccagcgcctcccttttcagaaattcttttctcaataaaagatgagaccctctcttttcttttaaaaggatgatttgtgtcctgtgtcttgtctgtctgctctgtccacaaaactgatgaaagctccactgcaaggcaaagttaatgttcccctcccacttctcaagaactcagaaatggaaatataactctgcactcagagagttaaaatagaaaacaagcaacagatccaagtggagacatgcagatcacacaagagatcggactctccaggatccagccttgccgctaaactcaccaagggtattaacatatctaaggaaaaggccgggcatggtggctcgtaatctttgggaggccgaggtgggtggatcacctgaggtcaggagtgcaagaccagcctagccaacatggtaaaaccctgtctctactaataatacaaaaattagctgggtgtggtggtgcacgcctgtaatcccagctattccagaggctgaggcaggaggttcccttgaacccaggaggcggaggttgcagtaaaccaagatggtgccattgcactccagcctgggcaacaagagcgaaactctgcctcaaaaaaaaaaaaaacatatctaaggaaaaaggtgggtcagtccaggatgccaagcaaagggagagttgagacccacaaactggaataacttgaataacgagtggatcagctgaggtcaggagttcaagactaacctggccaacatggtgaaaccccatttactgaaaatacaaaaaattagccaggcatggtggtgtgcatctgtagtcccagctactcgggaggctgaggcacgagaatcgcttgaacctgggaggtggaggttgcagtgaggcaagatcataccactacactccagcctgggcgacagaaattctgtcaaaaaaaaaaaagaagaagaagaaagaaaagaaaagaggagaatttcctgatgaagcataagtgtctggtccgaatgataacagcattctgactttcttgtttacacatctatcccttatgaatttgttcagtgtgtattgatcctgcggagtcctatcacttctgggtctacaaacagtaaacttcggagcgtataaaagcctacagaatatgctaacaaaactaaaatactgccaccatgtgggcctttccacaagcttaactgtcagtccccaaggcatttgtgtatccgatcaatatgtaaatgaacgagcagactctcttggatacaatgtggagaagactctaccaaaggtcactttccccaagccactgataacctttaaccagctcaaacccgtctgagctcaccacataaaacacccaaggatcctgcccactcccacaataccccatctccctcagcccaacaaaaacatcctcaggaaagttctctccaataaactcactgaaataaaactctagcagtatttgagcacctagggctgctctcctcgaaagatccctcccctaccaacacggagcctggtgtcagtccatctcagagtacctaacctcagttatcctttgcttctggccaaaatgcaagacccaaaaatcagatttttttgatgatgctcccttcttttggactctttctactcctttccatttcactctctccaaacttccttccttaaaatcaaatttttttttcttttttcttttttttttttttttttttttgagacggagtctcgctctgtcatccaggctgaagagcaatggcggtatctctgctcactgcaagctcctccccctgggttcaagtgattctcccgcctcagcctcccgagtagctgattacaggtgcgcaccaccatgccagctaattttttttttttttgagacagtctcactctgtcactcaggctagagtgcaatgacacaatctctgctcactgcaacctccacctcccaggttcaagcaattctcctgcctcagcctcccaagtagctagaagtacaggcatgcgccatcgcgcccagctaatttttgtatttttagtagagacagggtttcaccatgttggccaggatggtctcgatctcgacctcgtgatccgcctgcctcagcctcccgagtgctgagattacaggcatgagccacctcgcccggccaacagctaatttttgtatttttagtagagatggaatttcgccatgttgaccaggctggtttcaaactcctggcctcaagtgatccaccagccttagcctcccaaagtgctgggattataggcatgagccaatgcacctggcctcccctctctttttaacctctccacacttcttccttctgtgtgcaaaacaagtctctccatcctaaaaagaaacctgtggcccctgtggttccctccagctatctcgatgttctttttctcaaatcacactcagagcctttaatcagccaaacctggctccaattcatcacctgtatttcatttttctttctcttttcctttctttctttttttttttgtgtgtgtgtgttttttgagacaacatctaactctgtcacccaggctggagtgcagtggtgcgatcttggctcagtgcaatctctgcttcccaggttcaagtgttctcctgcctcagcctcccgagtagctgggactacaggctcatgcccggctaattttttgtatttttagtagagacagtgtttcaccatattggccaggctggtctcaaactcttgaccttgtgatctgcctgcctcggcctcccaaagtgctgggattacaggtgtgagccaccatgcccggccgtctatttcatttttctactcccagaaatggggtttctcttctcagcatgttactgaaactgctcaaaggtgaccttgtaatttccaaatcccatggacgattatgcatctgcatgtctcttgccctcaccctgccatgtggctccttttatttttcaaaccccttgttttggcccctaagatggctctatcccaattctccttctcagcttatgtcacgaggccctgagtatcatggcagaggggagaacggggaaccatgagaaacaggggggcaaagggcagcacggaatgtgttcccagttttgctggaggctgcccagtccatttcaggtttccttgctcatgttggcccctggaaaggcacatgatcccttgcaccagagacctgagtggtcaattcatgagcattcagtcttctaccagctaagatctgagtcaggccagagcaaaggaggtgggaggaacagagaggagagctgggctcaccggcagcagcctggctctgatctccatgtagagcacgttgtcctcgtagaactcctgcatgctccggaagacatagtctctgaacactggtgcgtaatggatgagaccagagatggtgaagaagatggtttcaaatttcgaccagacaacattttggtttgtgtaaatcacctccgggtgctgggtcaccagagtgaaattcctcagcaagctgtccaagacacgaagtggggagtggcagaggcatgatccaggacactgcccccgggcgcccataggactgctacccaccttgcatatcccagctagcagctcacaggattcaccctagagtggagataaggaaggggcaaaggggagcattcccacgctcacgatataagcatgggtcctgtggccaggcagcccactgcctgcttaaacccaaaccccaaacgcaggagactgcttaagatgagagctcaccagtcagtctctcctggctcctgtcctccctctgtatgcttggccagtctgaccccactgtactttctagaccaaaaagctctctctctctctctttttttcttcctatacccactgacaggaaactagaccaagctctttttggggaatgttatggactaacttgtgtccccaaacccccaaattcaaatattgaagccctagccctcatttggagaagggaattttaaagagatgattaagactaaatgaggttgtaaggatggggctctaccctaataagatgggtgtccttgtaagaagaggaggccaggcgtggtggctcacgcctgtaatcccaacactttgggaggccaagatgggtggatcatttgaggtcaggagttcgagatcagcctggccaacatagtgaaaccccatctctactaaaatacaaaaatcagccaggcgtggtggtttgtccctgtaatcccagttactagggaggcaagagaattgtttgaaccctggaagtggaggttgtagtgagctgagatcgcaccactgtactccagcctgggcgacacagcaagactcatctcaaaaaaaaaaaaagaagaagaagaagagaccgcaggagtgcacatacagaggaaaggccatgtgagtacacagccagaggcgccttctgcacgccaaggacagaggtctcaggaggaaccacccctgccctggcaccttgatcttagacttccagcctccagaaccatgagaaaatcaattccttcttttttttttttttttttgaaacagggtctcactctgttgcccaggctggagtgcagtgtcacaatcacagctcgctgcagcctcaatctcccaggctcaagcaatcctcttatgtcagccccctggggtagctgagactataggtgtacaccaccacatctggttaattttttattttttgttgagatggggatctcactatgttgcccagactggtctttctttctttctttttttttttaaacagaatcttgctctgtcgcccaggctggagtgcagtagcatgatctcagctctctgcaacctccgcctcccaggttcaagtgattctcctgccttggcctcccgagtagctgggattacaggtggctgccagcatgcacggctaatttttttgtatttttagtagagacagggtttcaccatgttggcctggctggttttgaactcctgacctcaagtgatccgcccacctcggtctcccaaagtgttaggattacaagcatgagccaccacacccggccaccaggctggtcttgaactcctgggtgcaagtgatcctcccacctcagcctcccgaagtgctaggattacaggcatgacccagtgtgcccggcttgagaaaatcagttcctattgtttaagctccccagcctgtggtattctgttatggcagctcgagcaggttaatgaagggagtggaatggaaataactcgaatcagcacccaggtttgtatccccaactggccatttaccagctgtgtgtccttgcataagctaattaaccttgctcagcttcacgtttctcatttcataaagggaagtaacctcaggggggcactctgtagacatttctgtgaccaaattaattgtcacttataatattactatacaatgccaggcacaatggctcggctcatgcctgtagtcctagcactttgggaggccaaggtgagaggacggcttgagccgcagagttcaagaccagcctgggcaacacggcaaaaccccatctcacaaaaaatacaaaaattagctgggcatgatggtgcacacctctagtgtgctgacacaggaggattgcttcagctgacacaggaggctgacacaggaggattgcttcagcctgggaggttgagtctgaagtgagccgagattgtgccactgcactccagcctagatgatagaatgagaccctgtcttaaatagtaataataataatgatactatacaagtctgttaggaagttgctgcatcagattttcaagaagatttatcttccagctagattgtcatcacttcagagctaggaacttttattctctctggttttattgagcatcagacaaatctcatttgctacagcaatagtgttgctgactaggcatggtcactcatgcctgtaatctcagcactttgggaggccaagatgggcagatctcctgaggtcaggagttcaagaccagcctggccaacatggtgaaaccctgtctctactaaaaatacaaaaattagccaggcatggtggcacatgtctgtaatcccagctactcagaaagctgaggcaggaaaatcacttgaacccgggaggcagaggctgctgtgagccaagatcaggctgctgtgagccaagatcacgccactacactccaacctgggtgacagagcaagaccctgtctcaaataataataataataaataacaataataataacaaacaaaaatagtgttgctgataatgctttttgtagattttaaatgcaccagaaaaactactatggatagaaaaggtgttgaatgcttttgtggagcaaagtatcctgcaaggttaaaagaaaaaggtgctcatgctttttttttgagatagggttttattttgtcactcaggctggagtacagtggctccatctcagttcactgtggcctcaacctcctgggttaaagtgatcctcctgggttaaagtgatcctcctgcctcagcctcccaagtacctgggactacaggtgcagcaccacacctggctaattttttgtatttttggtagagatgggctttcaccatgttgaccagactggcaactcctgggctcaagtgatccgctcgccttggcctcccaaagtgctgggattataggcgtgaaccaccgcactcagccttgcctcatgttttattaaagccagatttttatctataggtttgtaccaagggagacacctacccactgccaccccatgacaggcctgggacatgtgctttctgaactactactcacctgtcatcaaactcagtgacgttctgcacccgcttccgataatcctccagcagaatccacttggaacatttttctgatggacggggagttgggtgagcaaatctgaactgcatgatcccccttggggtgaaacagatgtggcagtgaggcctgtaggtgacattcctcaccagccagtccatagtcacgatgccaatgtcatggaggtgcaaggcagcccctggagagggaagaagaatggtgaagacaaaggggtgaagtcccatcccaggactccagggcttggggacaaaggagggggtgaagtcccatcccaggactctggggctgtggggacaaaggggtgaagtcccatcccagggctccggggcttggggacaaaggggtgaagtcccatcccagggctccggggcttggggacagtgtggatcacaagaagacgtgcaagcagaaggatttctgtccagacatgtttctcggaacttgtttaaggctctagtttaaggatggggcttccatgtctcactaatcaggagccaggggtgatcttgtccaagaggggcagcatgggagagtgagagggcatcaggcttggaaccagagaactgaggttcaagtcagggctccattggcttctagctctccaatgggagcccaggcctttcaatgaggccacccaacactgcatgacgggatacactgggatgagccccagggccacggtccttttcacacacttgtcctccatcctctcatcctgcccctcaactcctctcccactggcttttcatcccctgcgctgggcctgtgtctgtacagcttctggcctgcaggctttgccagttgaatccccatgcttgtcctccccaccagacaccagctgtgccccttgctcccctaggcacagtgcatgctgtccctctgcgcttcttgtgcccatccagcccctggccctgacacgagcccccagacaccctcttatgcctcccagcaactggggatgctactttactgacctcacgattattattattttttaaatctctatttataacattaaaagaaaaaaaaacagctgggcacagtggctcactcctgtaaccccagcactttgggaggccgaggcaggcagatcacgaggtcaggagttcgagaccagcctgactaacatggtgaaaccccatctctactaaaaatacaaaaattagccaggcatggtggcatgtgcctgtaatcccagctactcgggaggctgaggcaggagaattgcttgaacctggaagaaggatgttgcagtgagctgagatcacgccaccgcactccagcctgggcgacagaacaagactccgtctcaaaaaaaaaaagaaaaaaaaagaaaaaaaaaaaacaggtgttaagtctttgtaaactgcaagctgctattatttttacattttaaattaacatttttggccaggtgcagtggctcacacctgtaatcccagcactttgggaggccgaggagtgtggattgcctgagctcaggtgttcgagatcagcctggccaacatggtgaaaccccgtctctactaaaagtacaaaaattatccaggtgtggtggttcatgcatgtaatcccagctactcaggaggctgaggcaggagaatcacttgaacctgggaggcagaggttgcagtgagccaagatcacaccagtgcacttcagcctgggcaacagagtgagactctgtctcaaaaaaaattttttttaataaaaaaaaaaattaacattttttggggaacagggtcttgctctgtcgcccaggctggagtgcagaggtgccatcatagctccctgcaaactccacctcctgggctcaagcgatactctccactcagcctccagagtagctcggattacaggtgcaccaccacccctggctatttatatgtgcgggatgctaattatttcatgtttcatggaggtgtgtttatactactccaggatgctatatcacattgtatcctatgtggtagcttagcccctgggaaaactaaaaagggaatagcaaagtctcagggctggatgcttttccaatcctgactgtctgcgagtcccccaggaagcaggggttttggttttcaacacccttttcctagtctacccataaggacagaggagcagaacagctgagtgaggctttctctgctccatctagaatagcaacagccacaagcacagtaatagccccaagatgagtccctctaccttcccagcaccccaagccacccctttccaaaccttaccttttggcatcatccttagaatattaaacacttgacttctctcaatgagatgcttggcctggaaaaagtgcatgctgggtgggaatatcagggtcctcatggcctccttcatctcagcgattttgagcgtcatgagcctctcattggccagctcctccttggtgttcagcaccagccgcccccccagccgcatcatcttttctttcaacaacagatgcgcccgtgtttcatctatggatagagctgagccgaagaaagacattgccacagccaacagcaagaagcacagggctggccgctcagatgggccatccaccaacatcgggatgcctggactaggaaagggctcagatggagactccacgggactgcaaaggagagtgggggagtgaaaacctacagatttaagggtggaactctgatcttccttttctcgccctgctctcagattaccagaaggcaagatattgaaggattcttcttccagaccccagagaaaagacctacaggtacagacaggtaggggtttcccaatttttttttttttttttttgagacggagtctcgctctgctgcccaggctggagcacggtggtgcaatctcggctcactgcgagctccgcctcctgggttcacaccattctcctgcctcagcctcccgagtagctgggactacaggtgcccgccaccatgcccggctaattttttgtatttttagtagagacggggtttcactgtgttagacaggatggtcacgatctcctgacctcgtgatctgcccgcctgggcctcccaaagtgctgggattacaggcgtgagccactgcaccacctggcatttttttttttttttgagatggagtttcactcttgttgcctaggctggagtgtaatggtgtgatctcggctcactgcaacctccgcctcccgggttcaagtgcttctcctgcctcagcctcccaaatagctgggattacaggcatgcatcaccacgcccggctaattttgtatttttagtagagacggggtttctccatgttggtcaggctggtctcgaactcctgacctcaggtgatccgccagcctcagtctcccaaagtgctgggattacaggcatgagtcaccgcgcccggcaggttttcccaaattaaaggtcaccatgaggtcaaacaagccctggctcatgcataaagacactgcaatctgatttttagtggttcacttttattttattttatttattttaatttttgttttttttaagacagagtcttgctctgtcacccaggctggactgcagtgacgtgatcttggccctctacaacctccgcctccagggtttaagcgattctcgtgcctcagcctcccaagtggctgggactacaggcacgcgtcaccatacccagctaatttttgtatttttaatagagaccatattggccaggctggtcttgaactcctagcctcaagtgatccactcatctcagcctcccaaagtgctgggactacaggcatgagccaacatgtccagccagtgttttacttttaaatataaccagcatgcctgtggtcccagctattcaggaggctgaagcgggagcatcacttgagcccagtactttgaggctgcaatgagctttgacctcaccactgcactccagccttggcaacagatcaagaccttgtctctaaaaaaaatatttttttattaaaaaataaaaatacggctgggcgcggtggctcacgcctgtaatcccaacacttcaggaggccgaggcgggtggatcacgaggtcaggagtttgagaccagcctggccaatatgatgaaaacccgtcctactaaaaatacaaaaattagctgggcatggtgacgcatgcctgtagtcccagctgtttgggaggctgagacaggagaatcacttgaacccaggaggcagaggttagaataagctgagttcgcgccactgcactccagcctgggcgacagagcaagactcaatctcaaaataaataaataaaattaaaataagaccaggtgctggcacagcaggtggattgctcaagcccaggaattcaagaccattctcagcaacatgttgaaactccatctctacaaaagatacaaaaattagctgggcgtggttgtgcacacctatagtcccagctactggggaggctgaggtgggaagttcacctgagcctgggaaatcgaggatgcaatgagccaaaattgcgccactgcaatccaacctgggtaacaatgtcatatcctctctaataaataaatgaattggccaggcgcagtggctcacccctgtaatcccagcactttgggaggctgaggtggacggatcacgaggtcaagagatcgagagcatcctggccaacatggtgaaaccccgtctctactgaaaatacaaaaattagctgggcgtggtggcatgcacctgtagtcccagctactcaggagcctgaggcaggagaattgcttgaatccgggaggcggaggttgcagtgagccaagatcgtgccactgcactccagcctgccaacagagtgagactccgtctcaaaaaaagaggaaaaaaaaattaattaattaattaattaaatagcaaagaaacaattaacagaatgaagagacaacctatttttttcttttcttttcttttcttttcttttgtgggggacggagtttcgctcttgtcaaccaggctggagtacaatggcgcgatctcggctcaccgtaacctcctcctcccaggttcaagcgattctcctgcctcagcctccagactagctgggattacagacacgtgccaccacgcccggctaatttttttatatttttaatagagatggggtttcaccacgttggttaggctggtctcgaactcctgacctcaggtgatccaccagactcggactcctaaagtactggcattacagacatgagccaccgtgcccagccttttcttggctcactgcaatctccgtctccctggtccaagtagttcttctgcctgagcctcccagctcctgagtagctgggactacaggcatgtgccaccaggcccggctaatttttttgtatttgtagtagagacggagtttcactatgttgcccaggctggtcttgaactcctgacctcaggtgatcctcctgccttggcctcccaaagtgctgggattacaggcgtgagtcaccatgcccggccaatctcttgaataggagaaaatatttacaaattagttatctgatggagagctaatatccagactatataaggaaatcaaacaactcaacagtaaaaggacaaataatctcacttaaaaaatggccaaagacccaaagacatacaaaatggccaatacgtatacgaataaatgcccaaatttttttctttgctttgctttctttctttcttttttttttttccttgagacagggtcttactctgttgcccaggctggaatgcagtagcgtgagtccacttggttggactccaaagctcgctgcagcggcaacctcccggcttcaaggaatcctcccaccctagcctcctgagtagctgagtgtagtaccactacactcagctaattttttttttttctttagagacagggtctcactatgttgccatggctggtctcaaactcctgggctcaagcgatcctcctgcctctacctcccgacattctgggattatagatctgagccaccaggcccagccaacattttttctaatcactgggggagtgcaaatcaaaactacaatgagatcgtctcaccccatctcaaaaaatggctattacttaaaaggcaaaaaataacagatgctggtgaggatgtagagaaaagggagctccttacaccactggtgggagtgtaaactagtacagccactatggagaacagtatggatatttcttgaaaaactaaaaatagaactaccatacgatccagcaatcccattactgggtatctatccaaagggaaggaaatcagtatgtcaaagggatacctgtactcggatgcttattgcagcactattcacaatagcaaagttatggaaacaacccaagtgtccaccaacagatcaacggataaagaaaacgtggcaagtccatctaccgaagcaccggggagtgtcgtggatgcctacgagcaggtacaaaaaggacttctaaagctgaaaggcgtcgcagagctcagagtgaccaagcggaagaagaaaaagaaggacaaagacaaagctaaactcccggaatcaatgggaatgaacaaaaagaatgaggaggagaagcagcacggcctggacaagtggaccccggcccgcgcagcctttgagaaaatgcaggagaagcggcaatggaaaggatcctcaagaaagcatccaggccaggcttggtgactcacgcctgtaatcccagcacttcaggaggctgaggcgggtggatcacctgaagtcaggagttcaagaccagtctggccaacacggtgaaaccccgtctctattaaaaatacaaaaaattagctgggcgtggtggtgtgtgcctgtaattccagctactcaggaggctgaggcaggagaatcgcttgaacccggtagggagaggttgcagtgagccaagattgttccattgcactccagcctgagcaacaagagcgaaactctgtctcaaaaaaaaaaaaaaaaaaaaatagcatccaaaacccacaagcagagagtggaggacttcaacagacacctggacacactcacggagcattacattcccagagtcagctggacgaaatagccgcctgcccccagtagggagcagcatcgagggttggcaaaaggccatgctggggttgtgtgtgtttcctttggtatattctagaaacatggctttacacacaccctcgcatcttctgctacaaactgcttttcgaagctgtgtaccctcattctgtaacttgattaaagtaaaattgtccttgtactcagtttaggtttcttggcaacatatagaagatacacccttttagttcggatggaaagtttctaagtttattcagaggtaaagcccatttctgtgtccgtaccatgtaaaaatgtttttatccccgagttgcatctaacgctctgaggccagccagctgtcttctccaggatcagatggactccagaggataaggagctaatgccagggtggcctgtagtatgcagagctccgcaggacccagcatgggtgcccctccaagcttcctctagcttggggcctatgctggtcctgcaggccccagggaagccatttgcaactctgtggccttcagacttcctcctcagccactggccactgagacagcacagcctgggtggcagaacagccacctaaggcaagaatggaaggaaacactttgttcctttctgagcccattccccaaaaccctccttccaggtactcctaatgggtattgccatggcagacattgctaatggatcacagcattctttgaaatggagcccagatatagcctgcctgtcaatcctcagctgggggctcctagcagcctcttgtatttattcagagttgacacatcacacggagcctgtctggcattcctaccctaaggacacctcaggggtgacaggaccagggcagagccccagtacaaacagacatgggtgcagtcaaatgggagggcccaggcatccgtcttggagggctgggattttgtagggcctgtgtgtcctggttgaggatcaaaccgcatatgctattgggagaaacaatctctgtggacatacatactgaaagaataacaaaggcagaagagaaaaacaaagtgtggaatttggggttctcctgtgtaaattacacaagaaagcagaagccagttatttaaaaaagaaagaaaatgtggcatatatacacaatggaatactactcagccattaaaaaatgaaatcacgggctgggcacggtggcttacgcctgtaatcccagcactttgggaggccgaggcaggaggcaggtggatcacgaggtcaggggtttgagaccagcctgaccaacatggtgaaaccccgtctctactaaaaatacaaaaattagctgagcgtggtggcggatgcctgtaatcccagctactcaggaggctgaggcaggagaattgcttgaacccaggaggcggaggttgcagtgagccgagatcatgccattgcactccagcctgggcgacagagcaagactccgtctcaaaaaaaaaaaaagaaaaaagaaatcacgtcatttgcaccaacatgcacggaactagaagacataatgttaaatgaaataagccagacacagaaggacaaacaccgtatgttcccactcatgtgtgagagctaaggaagttgatctcatagatatagagaatagaaagatagacaccagagactatgaagggttggggtagacatgggggatgaagagaagttggttatgggtacaaatagacaagcacttcaagaggctgaggcaggagaatcacttgagcctagaagttgaagactggcctgggcaacaaagcgagacccccatctctacaaaaaatttaaaaattatcggcaggcagatcacgaggtcaggagttcgagaccagcctgaccaacatggtgaaaccccatctctactaaaaatacaaaaattagtcaggcgtggtggcgtgcacctgtaatcccaactacacaggaggctgaggcaggagaatcgcttgaacctgagaggcggaggttgcagtgagccgatatcgcaccactgcactccagcctggggaagaagcaagacttcatctcaaaataaataaataaatataataataaaaattatccatgtgtagtggtacacacctgtactcccagctactcagcaggctgaggtgggaggatcacttgagtctgggaggtcaaggctgcagtgagccatgatggtgccattgcactcctgcctgggtgacagagtgaaaccctatctgccccactcccaggaaaaaaaaaaacctacagttagatagaagaaataagttctaatgtttcatagtagactagggtgactatacttagcaataatattatgtatatttcagagtaactaagaccgggcatggtggctcatgcctgtaatcccagcacttagggaggccgaggcaggtggatcacaaggtcaggagttcaagaccagcctggccaacatggcaaaaccctgtctctactaaaaatacaaaaactagccatgtggcgtgtgcctgtaatcccagctacttgggaggctgaggcaggaaacttgcttgaacccagagggcagaggttgcagtgagccgagttcgtgccactgcactccagcccggcaacagagcaagactccacctcaaaaaaaaaaaaaacacacacacacacacacatatatatagagagagagactcaaataaaatggattaaagttaaaataaataaataaataacaaatataaccagagcacaagatcataagacatgcttcaaactgagaaagaaaccaaaacaaaacacacagagataaggaactgagaggaaacaaagcaacacaggaaataaaagaaaaacctgaaagaactgtaattaacatccttaaagacataaaacattgtgtgtgtaaaacaggaacaggaggtgattaaaaaaatgagaattagaaagaactttcagaaattaaaaacagcaaagccgaatgtttaaaaatttactagcaatattaaaaatgaagttaaagaaaatatttttaaaagtaaagcaaaataggagaaaagaaaatgagatgattattggttgaagaaatccaacacccaaataacagacatttcagaaggaaaaagaaaaaaaaaacaggtgaaggaaataagccaataaggaatacaagaaattgccccagaactgacagtctttagattgagtaccttgcacagcacagtcaatcattctgtggccacaccaaggtacagcatcttggtatttcagagcattagcattagaaaggattatcaaaacttgcagagagcagccagttcagggtggcaacgagcagggactgaaggaaggaaatgtattcagcatctcctcacacaaggctctatgctgctcctttacctgggttatctatttgaattacatttaagaaggggcagtggctcatgcctataatcccagcactttgggaggctgaggtgggcagatcactggtgcccaggagttcgataccagcctgggcaacatagcaaaaccaaaatacaaaaattagccaggcgtggtgtattgaacctgtagtcccagctattcatgaggctgaggcatgagaagttcttgaacctgggaggcggaggtttcagtgagcctagattgcaccactgcactccagcctgggtgacagagcaagactctgtctcaaaaataaatacgtaaataaaatttttaaaatgaaaataaaacgattgtttctctacacttgaaagtatgatacagcatactggaacatgtcaagactgtaaattaggagaccttaggaacagcctcaaattagtatcattctaactgtgcaaccttgggcaaatcactaacgtctccagatctcagtgtcctcacctacaaaaaaggtaacttggacaagatcagtggttttccaagtgcagcatgaatatcatcagtggcataaatacaatcttaggtggctcacaaatggataggggttatgttgacagataggtaattttaaaacatgtattagcacatcaaacccatgatatcgtaactattattgtttttgttgaaaaatttttaagttaaagaaaaatattaagtaaatagaggtgcaaggatatgacaaaaatggaaagtttgctactcattaaatcattttaatatccaagattcttcccagctcagttattctgtagtacatcagatagcaaagaaaattttaagaaggaactagtatcagcaatatgcagttatggcagaagctgtacccccaaaatcagagtgctggacgtcagcagaacccctttaacttcattaagtccttgactctcttttttgaccacggtgtttgcctgctactaaaatctctagggcaggagcacggtgacttctatgtcaccatcccacctaccccatgccacattctccatcaacagccccgccccttgtccctgtctccctggtgacacataacaaaggccatcaagctcccaaatcttcaactccatcctctccaagaaggaccccaaaagcatttgtgtcccagcaactgtgaacttttccaggctgccagacagaagtttatctaatggtggtcaagacctgcctggttgaatactagtaaaaacaatccttattcacaatttattgctatatctacttcatcttctctcctccacaagattttccttttacttttaaaagaggatgcatgaaaacttcataaagtagtttgcttccagactaagaagaaaggaggctgggtgtggtggctctgcctgtgatcccagccctttggaaggccgaggcaggcagatcacctgacgtcagtcgttcaagaccagcctggccaacacggtgaaaccccgtctctactaaaaatacaaaaattagccgggcgtggtggtgggtgcctgtaatcacagctattagggaggctgaggcacaagaatggcttgaactcgagaggcagaagttgcagagagccgagatcgtgccaccacactccagcctggtgacagtggagtaggccacatgcatctgtggtcctgagtaaatgcccttgggcccattttcaaaagcctgttgggagaaagcctgttactcctccactgagagtctcagacccagctcagatggagacagggagaggtgcaggtggatcaagcccaagctccggacttcccagctacctcctgaacctcatcatcccacagctcccaaaggaccccagttacctcggaacagctccagaaactgagggctgtttgctcagcgccccagcatctgtgcagagcaccggaaaagctcaccaactgtttcacttcctgttggggtaggttttatttccctccagtgtgcaccagggatccaactagaggccggggagaggggctctgcagtgctgaggcagccagagtggcaagtgtgtggcttacatgcatgcttgctgtgtgcatctgagtttgatgtggggggcttgtgcgcatgttcatgtgggtgtttgtgtgttcgtgtgtgtttcggtttatgtgcatgtggggtttgtttttttttttttttttttttttttgtagacagagtttcactcttgttgcccaagctggagtgcaatggcgcaatctcagctcactgcagcctccgcctcccgggttcaagcagttctcctgcctcagcctcccgagtagctgggattgcaggcgtgcgccaccatgccccactgattttttgtatttttagtagaaatggggtttcaccatgttggtcaggct

SEQ ID NO: 250 - DNA, 77975 bp, Homo sapiens
tcttacaaacacagattcttttccacaaacctctgaggtagggagtaaaatatggaggccaagaacacaagctctggaaccagactgtgtgcgtttgacccaggttccatggcctactgtgtgaacttaatctgttgcgtaactctctctggcttagtttcctcctctgtaacatgaggtcattagtagtacctgtctcataaagttattttatgcattaaaggagttaatatattgtgtaaagcacttagaatagtgcctgtcaaataataagcactcaataaaagttgttgctgctcttatagttttaatgtattctttcagatttgggttgtcatggtatgtactcccctggtcatcagttaattgccgatttctaccatcaccccttcagaatacagtatttatcattcatttggtgaaatcttaacaaagaaaagatttactagacctaaattaatgcaattcttaaaaatcagattaattttaaagtataagggaaatttactgagcaacatttttcccttacctaactcactttatgatggaaaattaggtgcttgaggaagtgtaattgatacactacccacagtatttattgccagaaatgaattgttaagtatcttttgttgggaagatgaatctgtgaagggggaggagatgaaggaataaaaataatccacagtcaactgggaaaattctgaaactattcagttatgtacataatatcattcagttatgtatcttagatttcactatagagaccctattggcttttgagactaatgtgtaggaaatacgaattttattacttttgctcttcagtagactagttcttttttttaataacagttttgccttatgggaaggaaataatagtttttgttttcctgaaagcagatcataaagcctaaagcttacccccattcctaaagtttttatatcccttgactatggtgattattatttttataagccttgtataccaaagttttccccccaaaattatttgtaatatgttgtacataaagtttcagcataccaatatccaaaaagtgggatttctggcttgattattggaaaacaagtcagtgtttggtttatacaggttaagtatcccttgtctgtaattattgggaccagtatttcagatttcagatgttttcaagttctacaatatttgcatatacatgatgagatatcttggtatcttgagataccaagtccaaatatgaaatttattttcatatacaccttatacacattgcccaaaggtaattttatacaatatttttaataattttgtggatgaaacaaagtgtgtgtattgaaccatcagaaagcaaaagtgttactatcttagccacccatgtggataatctgtggtttggcatcagtgttactcctgactctgaatttacatactactgttaagcaatcattttctaacacttatttacacgtagatatatttagcaaaaaataagacatatcagtgaaaagataatgtattcagggtagtggagcagcacaatagcatcaccagaatacctgtatgttatcactattaaccaaaaaagtatctgcagtcctttttgacattttcaacaatatctttataccacacagcagagaataagcaaaaaacaaaaacaaaattgaaaagcagtaatgcacttagttcttggccccatgtcgggcattggggagaacctgttgttggaatgtccagcctgcacaatgccattttattaccctttgtgggtgtacttacgtgacaggatatgggtctgtgcacaaagatatattgcagctatgaagggggctgggagggtcgtttttcccttggggatgctgaataaacttttgtgcacctacgttttgacctcgacctgtcacataagctcaagtgtggaattttccacttgtggcatcacattggcactcaagaagttttgggatttgtagcattttagattttggattttctgattagggatgctcaacctgtgtgcctaattatttgttataaatatggaaatgcataaaacattgtaaatgaagttgtctgtgcacgttatatacatatccttatttcttaggtgatgcctggtagtaaattccttcaggtatactttttacctttttccattatgatttatacatataatctacacatgtacatagtagatataattttttcttttataaagatcaaatgttttgtcctgtcttgtaattaatataaacatcctttttaaattatatgttttatctgaggaactctcagattcacatctgaaatggagttcccagacccagtaaactagcaatctaatttcaggattcatgaggtgaggttgcaacgggaaaacagattctccccctgccccttcatcctattgttagcactttggtcctactgttagcatcattaaaccaaaagggaacaacccgacttctctggtgatatatttggagacttagtgaaatattctgttttttcttttttaacaactcccaatacggattcccataattgaccccagatcactatattatttttttctttttacttagcattaagggttcattactgaatatgctgttttgaattgcattctgttaatacaggaacaaatactacatattgagctctcacatttttgtgtgccaaatggagaaaagatatttacttagggttcaggtatgaaatttacatctcttctgagattgaggccataaaatggaaattgccttccaaatcctcattaagttagaaggcttttactgacatttagaaagcaagtttatggtcagaacaaataaaaacagtgcagatgtcttcataaggctgattccagaagatcagctgttttgtaaaggtaagtgatttgcatctattacatatggattacccattctttcccaaattttttccccaaagagatgaatttttaccaaagattatagttattgttgttgttgtggttttccttttttttttttccaaaggaaagcagttgtcttcatgcataaaagtcagtgcttgttttatacattgcaagaaacaaaaagcatattttttgtttgttgcttccccaaaagacattccttttagaatgccttggaactatgttctatcatatcactctttaaaaaaaacaaagaagaatatattcttatttggaagagacttaatataatcaactcatggttacttttactgatgcttgagtcttttaaatgtagtaattgatcaaattgtattaagccataagggactttctggaattcagttaaggcaactaggtgagtgttactactgcaggtgaggtttcaggattcatttggtcagactgaagacgttctatgtagtataaattgattatatctcattcttgaactacaagactttaaaatgcctttacacttaaataattctgatagggtgattttcctttgtagacactgtaattatgttaacatttgctgtattttggtggaattcatttacattaaaatgatttacaaacaggcattcccacattctttggaggaaagtgtctaatctcaaaatggtactttttatttctgctctgatgtacaaagcctgtaaggacattttatcatgcttataagaaaactagtcaaaatttactaactgatattagtctgcattaatacaaactattgaaccaaaaaacatgacctttgtaatctggtaaagatactgataatttaagattttctttttctatgtctaacctttttaaaagtgaatttcattacattgttattatttggatgcataccttcatggtatgagtctggagagttttcacctggctgtaggacagacaccatggtccaaaggaattcttactcttcccaactcttaaagacttgaaacttcaagcagacctgacataaagatgtctttggtatagctctttggctatttctaaagagtggatgcactttggccacctttgataagttccaagatgatgacagaaagaaaaagattgggaaagacagaatgtgcctgttctttttgacttgagggagagagagaatgtgccaccctccttgatcttaagcgtggggtgagaatggcaacactttgtgttttttataagtagtgccaatttttaaaggatcacctggtgagacttgggattcctttgactcgagcttttccttcactttgcctcatattttcttggtagctcactttctttttcattgctaatgtgggggctagatgtttcttcatactctcccaaaacaggagttctacatagaaaggaagagaaagggagattttaatcttcatttaacaaatgtgtattgagccacctacaataaccagggctctagagagtgtacaaaatcaattcaaacaaaatccaacactcaggagcttatgttttggtgtatatagctaacatatatgacaaaagtgatgaaaaccttaagaatctatgatactttgcgcctaggtcaatagcttgcttccttactttgtggtccaagccatgtactaattttcctggcttttctaatgtttgtgtttattcttctttcaaagggcaacaatttttatgatcccaaagcaatttcaccaaattttaaatacagttatgactctcattcagttcatttatgacacagatgactattatacagagatggtactcatttagtaccctggccctaatacagggctgtccctgtaatagaataatgctttgcttcttttggaatctgagggaagtatagtattttcccttttgccagagagatcttttgtctctatggagtcaaaagtgggaggggtgggaagagaggttgggaaccaggaaactagccacagtattgagtttcagccaggtgcatcagattgagaatgtaatgtccctagtttattgaacaagagcagaaaaatctcttggagttcaaagcaaccatggtgttgattttctcctttcttgaaaacaagttttgaacttagactgtagaggttggagatttagggggagaagataaccatttaggataatccataaagtttaggacttgacttagttgacctagttaattttagaactaggttgacctagttaattttagaaaatttaacactgctacagtacaatttaaacttgaacatttgatttcaattttttttagagctgcatttttgcaagaggtaacagagttatctcaacaaagtgagttcttgagagttttgaagaaataaagtatccaaccattaagatttatgtcttccagtcttaactgaggttttctatatagtaggaagtgccacatttgctatttgattttaaaagtgtagatagatgttagccatacaaagtgtaaacagccctaattaaaatgctttcattgtgaccgggcatggtggctcacacctgtaatcccagcactttgggaggctgaggctggcagatcacttgacgtcaagagttcgagaccagcccggccaacatggtgaaaccccatctctactaaaaatacaaaaattagctgggcgcagtggcacatgcctgtaatcccagctactcaaaaggctgaggcagtagaatcacttcaacccgggaagcgggggttgcagtaaaccaggatcacaccgctgtactccagcctgggtgacagagcaagactctgtctcaattaaaaaaaaaattttttttttcattgtaagaactcatggcttattaaaccactgggggcttttggaatcttgtttctataatcatttgtttctattactagactacgtcatttattttactgttgctttcttttcaatccatattggacaaaatttgagaccaaaatttaaagggaggggtgcgaaaaagaagagactcttaaatgatttttaaaattcagtacaagtgtatttcattttaaatgatagatattgtgtttgcaaaaatgcatgacatcaatccactctgtcccccatacttcaggtaaataaacacattttcagtatactttatgaatatattattcacttttctgaaaagtacatttaaacttcaaaattttgtatgcacaatagtagaatctgtttgaatgtacttgacctgttttttcttctgcattgtgaatgccttcttaattgccttctgcttttactagctgcctgtatcctaacaatttggagttgggaactcttctgaatagaaattttatcttccattctctatactctgcagatttttatatctagtcgcaacatttctattatgattcatacttcctcacaacaattatgaatgttctacagatttagaggtagaattcaaaaacatatacaaggaaaaaggcagggtgcactccttttattaaaaggccagaacacatcctggttcactgttgcaagaccactgggatgcattaggtgaatctaacttagcttgtgacacaagttaataaagttgaatctggtttttttgttttttttaaggttgatggctgaagtgagattaatttctaaatagtctcaactcttgagacttgctatattgcttataatgaagaggaaaaggacactttcattactttacgtatttatgtaattggagggaatggaaagtttttgggaatatgaatcaaatattagactgttttcttattttagtttgtatatgttttaattgttttctctctctacccattaaagattccagtgctgaatattcaaatgaaaatttttcctgcactttgtactgtagcagggaccatattttcctgtacaaattacttccgtgtaatcttcacaggtggtgttggcaaaaatggatcaacaatagcagtaagtataccttaagattttcaacacttgtttacactaggacttggttttgttgtcattttgttttttatttcaaatgtataaaatcatttgttaatttataatttatacttagcctttaaagaaactaatgttcaaaacttcaattttatatatacttacccacatttatatgctttatatattcatacttttatgcatacacacacacaaacacacttattcacatgttttttaaagtatgagctgctttgtaaaaataagcctggtctcttaagtgaaatcctcagtttgtgcctaatgaatttatgctgctacttttcattagctcttctagtttgtgatttatagaaattgctgcctatcaggcaccatgaggttcctgaaagtttgagttgaactgtgaactgttctgcagcagatccatgtagtatctgatgagtactgaatactattaactcttctcttcactctgtacagggaacaagtgtcctttctccttttctccatattggatcagtgattacattagctgcaatgatctacaagaaatctgcagttcagctttttgaaaagcatccctgtctttatatactgacatttggttttgtgtctgctaaaatcactaataagcttgtggtaagcacctgagtttttatttgctgtgtttttcactttcatcttattttggatttatggctatagttctcattctgtagcttcataaatggtcctagagtttgccctcttctaatcagaatctcttgatatcaacatgggaactatttttactcttttgtgaagctacaatttgaagttactggaagttcttggaaaacatacaactttttacccttttatccactgtttaatttggttattcagtttatttacattctcagtctcaatctggacactcaaattaaggcttcttgtgaaaagcatcttttgtagggttagttgacatgatacatccctttctttctcagacgcatttcatattgttgggtttttagttttgggaattcaacagctattcctaaataattattggaagttgatatctgagcacaatatgatttactgtgtagttcacaattgtcctcttatgaaaatgcctacgttattctgttttattcataggttgcacacatgacgaaaagtgaaatgcatttgcatgacacagcattcataggtccggcacttttgtttctggaccagtattttaacagctttattgatgaatatattgtactttggattgccctggtaagtattgtactaagtcttatttcatggtttgagggtttgaaggttgcttgttttcttattttgatgacccagtcatgaaagatcgttcatataattgtaatgatttggaatgtcagaaatccacataaatggggctgtgtgagagttctatggctttatatttgagccttttattttttgcattaatcttactagtcctgcctacatcgggcagggctcataaattgcaaatttctgactgagtagaaaagcatgaatcagcatactacaccctgtgggcccatagcctgttttggtaaatacagttttattggaacacagctatggccactcatttatatattgtctgtggctggtttcatggtacaatggcagagttaagcaactgtgacaaagacaataaggcccataaagcttaaaatatttgccatctgtctctctaacaaagagtttgtatgtgaaggaaagattgcaaggaaattgaattattttatggaatggaaggtgaatctgtagagagaacagagtccagtcctctttactttcaggaagcttagggagagcctaaacgggtgctgagaatgtctcttttctttccaggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatggtttttttgtgttgtagttgtcacctgtgtgattatcaatcatttagaaatctcatacccttcccctaaattttcagcaagtgcctgggcctctctaagaggtcactttgtactctccttttctggcagtctcctctttggtatctgtactatcgtttgaaatgggaaccagatatgtttccattttatacagataattcagttgcttgaagaagagggacacaggagaaaagatttaaactattggctaaaatgaggtgtcttattattgattttcatctatatcttgtcccataatcaggaataaacagtagctacactgccttgtatggcagccagagcgctgcttgcttgcacttttaatgattccatcaataccatgtagattgaattagcaaggagaagtaaacctttcatttctttgccagactatattgggaaatgaaaatccgtcattacttttccttgctagcaattgttcgaatatctgggataaagaaatacatacaggaaaatgttagggcagaccaagtattaaaagctaggacagagcaggacaaaggaggaaggataattctacttgtttggcaaagttacatcagttgtcttactgacacatcaggtactatctatagtggaaattgaggcccggagaggttaaatggcatgccagtgtcacttgctatttttcagaacaaaaattagaatccagatctgaatcctggtgcagtgttctctcctatgccctactgggctttagtgggctaaagttctgaagcaagatgttaagggctaattgaaatgtgtttattctcctagattctttttcagcatagatggaatctgaaaagcactcagatatttagtgtgtgcttccttcagccctaaatacagcattagcatcaaatcaagggtacatttgtaataaacctcagcaaaccttacctgaagaaccttttaagaaagtacagatttccaggtcctatcactagagatgatttggtgtatttgtgatgaggcataagaggatattttcacaagattctcaggattccagttcctgttctgaaacctttggaggtacaactatatttaggcaccactgccataaactaccaaaaaaaaatgtaattcctagaagctgtgaagaatagtagtgtagctaagcacggtgtgtggacagtgggacatctgccacctgcagtaggtctctgcactcccaaaagcaaattacattggcttgaacttcagtatgcccggttccaccctccagaaacttttgtgttctttgtatagaatttaggaacttctgagggccacaaatacacacattaaaaaaggtagaatttttgaagataagattcttctaaaaaagcttcccaatgcttgagtagaaagtatcagtagaggtatcaagggaggagagactaggtgaccactaaactccttcagactcttaaaattacgattcttttctcaaaggggaagaacgtcagtgcagcgatcccttcacctttagttaaagaattggactgtgctgctcaaaataaagatcagttggaggtaggatgtccaagactgaaggtaaaggactagtgcaaactgaaagtgatggggaaacagacctacgtatggaagccatgtagtgttcttcacaggctgctgttgactgaaattcctatcctcaaattactctagactgaagctgcttcccttcagtgagcagcctctcctcccaggattctggaaagcacacctgactccaaaccaaggacttagatgccctgtgtccagtgctgctgctgcttttaccagtatctcttacccttccggttagaagaagtagagctgctgccccccatgattctatcactccaaacatatccccatggccaggtcttccacttgtagtccacttgattgtcatattcattgccttattttccacgaggaaaatacttttacccatagtaaaagccaaagacacatataaaaataagattttcctctttactctcgtccttacatgtccacagacttcatgtagagaggctgagcctttcgaccacaaagtgtgttctgtgttgaagatgttataatgatgggagagggcagttgcagcagcttctaaccaagtgtctacaacacatgtactactgtttcctacctgtgtcacctctgcaaaaaatggagctctgagcccagttctgtgagcatggtgtcagagccctccaaagtcctgagaaatcaataccagggatccaaatctcagacaccagtttgaagcaatacctggataccaagactcagagtgaggatatggattttgggagctgacagttttgctgatcctgccacactggcaggggctgaagtccagaaatggtgtgtagctctagtcattcttattcaccacagctcttatttcacagttttttcccttggtttcttctgtttcttctgttcctcatattcaagtattttctgttggaaatagcctgtgggttcaaatacaggtgttagaggcatctgatctggtcaggcagattataatgagctcaggaataaggatcagaaatatcctgtctgctccccatactgccatccctgccaggatgtctctggcctcacaggttctggagatccagacattcagttttgtccaaaaaggagcccataaacagaggatacttagcaggaattagctctagactaaaacagaggaaagggctcagtcctgttcactaatgggtaaaccaacttccacaaaatggcagcccattagacattttcttaggtttcaggttatgtcatttcaactccactaataaaagtctacctacagctattttgtgggtttctaaagagaagtattctttctttcccctcctctttattctagaggtaaccctctatgggcttagactgatggggactgttactgtacctgcaggaggattcttgctcttctcggcttcctggatgaaaagtgagaagagctgtgtcttcacaaacttcttcacaaatcggcggttggtcttggaggtcagagccttacagaaggatctttcttggaagtggccttgcccatttgcctcccgcttgatataggaagcataatggcccacaatcttgacaaagaactgcacaaaggggcctgaaacatgctcgttgatttgttctgcagctgcaggagatataaaggccatctcagagggtagcagaaggatgaaattacccaaactcaccttcaagaatggctttcttgcaggcggaaagctcctggggaaagccatagggtagggttcataattactgactgagatgggaatctgggtatgagttctctgccattgcttaggaagaatacaatcccaaattcagacttgccctaggttctaggcctctagggctggtctaggactactgaatgagttcattttagttctggaagggaatgattgagaagcatgcccttgcactgcctggagagacccaaaataagagtaaggacttactctttaactcattgatcccctgaccaagagagtctaagatgtcatcctgaagcttcggtggcaggatgtctttttcatcaccaacctagaagaggacagagctccgaggtcaagcaggaaggaagtgtggagtgaaggtggttggcagaaaagcataaggagggcatgaattctacacccccactccacccgcaaatagccacataggacagaaacaacagaagctgtttcttggcctttagtttgactctagacattagcaagggatcctctccatcccggtggtacttgatttatatcccttgcttaaaaggcactatcactgattgtcttatagtgaagtcatctgtgtttatgtccatgggctccttgagagagatgtggtctttttagcacagattctcactcaacaaagaacttaaatgtttgtttaaataagtggaacatggatgaaactagagtggtagagttgttgataggcctgcaggggatctgaacccagacacttaccgacattaagaaggttccttcacaaagattgaccagcaggacctgaaataaacatagactggctttctctggtcctctttcttcatagacccccagaggatttaccgtcttgatttctgcctgtggctgtatctttcagcccaggtagcaacaaaatcaatatcttcagttctcatttcctatctagcattctcctttctcaccattcccctctggagatctcagttccattcctgaggaaagggtgtgggtgtttgtaggaagggagtaggagaaagagctaaggtagaagggaaatacaagatggagaaatcacagccagtcactcccttaataaaacattgactgcagaaattgcttctacatggagcatttagtacattgttcacataagtgctttacacgtttgatctcaagcaacagtcccgtgaggcagatacaatctccattttgaagatgaggaaacagacccaaagaagctgcccgaggtcatactatgctgctaataagagaaccaatttttttccaagcctagactgatattcttgagattgcattcctctctctacaattccccttcaactccctgctctctagaacagagaccaacatctttttatttttttcatgcttgcaacatcttatgtacaattttctattagaaaaactcctgcctctcgtggtggctcacgcctgtaatcccagcactttgggaggccgaggcgggtggatcacgaggtcaggagatcgagaccatcctggctaacacggtgaaaccctgtctctactaaaaacgcaaaaaatcagccgggtgtggtggcgggcgcctgtagtcccagctactccagaggctgaggcaggagaatggcgtgaacccgggaggcggagcttgcggtgagccgagatcgcgccactgcactccagcctgggcgacacagcgagactctgtctcaaaaaaaaaaaaaaaaaaaactacctcacagctttgggccttccagcaggaaacagcaaaggaagaaaatgagcccagggtcaacaggaagaggaaaggaaaggaagtgaggagaccatgtgtctacagtcctcaagtgagataagcactgggctggaacttgggggacctgagttttagcactggccccatcactgcccagggagccttcagtctagaccagagattacaaataggcatcctgctggctgattccaaccagcagatctgtttctttgatcttcacagtatttttaagtaattgatttggtttccaatatttaaactggactatctcacataaagtttggatttggggcttctcctgaaaagtcaggagatctaacactgggtccacatttctaaaggacaacactcagatggaactgagtagcagttgcctgctttaggcagggcatgttcccaccagtttaccgtaacttcccaaatcatgtattggtcatttaaatgcccgctgggcctctcttttccatttgtgacccttggtcttgatagagagaatgatccctccattgtcccttcttccaaatacaaggagagagtggaaagtatgccaaaaaatagagcatgcactgtaattatctgtcatcaggggagaaaagttgaactagtccaggcctgaaaccacttgtatacataggctcagatgccttcatgaagggaagactgttcctttgagggattggggggagagagtgtgtataaataatttgtttttcaagattgttcccagaaatctttccagtatttgggcatattattgtctgtggagtaatcccttaccaaaagccagagtctgactggccatcaggagaggagccacggcttccagggagctggagctgcagagtcaagaagtttcataatttctggggttggaacatttaaatgtttattgctaaacatggggctaatactctgtcccagttagtcacaaggctaaagctggttcaaagggcatgtgtactcagcagtcctaaggaaggatgagggggccggtggagcaaagaagggaaacacagccttcttctttactttgcagcaatggtttctataggagaggatttggttttatctgtgctaggttccactgttgtctatgtggccttggataagtctctggagctcagttatctcttggagtgagtcaatggttatggccagggcagacattcccaagtccctcttctggcttgagatacagtaacatactatcttttgaaagtccctatactgacaactctaaagcacatgttttgagttatttttccaacagcggggatagatttacgcttttaatgcccattttcacaactgagttctctggtgtgtctggtgcactgccaagatgtaagaagctaacaaaatcaaagaggattcagacctatatcctcattagccaccttagctctgagctactcagaaagatgacttgctgcaaaaatctgcatttttaagactcatagtttgccagagggccatgttagctcaattccaaggaattcaaatacattccagtggggtgtgtgttgtatagaccagctgtgtcatacatttggatgagatgggacaccccgaagactgctcattagggccagctggcacagaacagtctgctcacccctgaataagctatccactgccccttatgcctaaaggggaatccttcagaagggaacctgcatttattgagcatcacctgtgtgtcgggtgccaggttaggagctctaggcaggtggtttcccccagaatccttaggaagtgaacactgttatccccattttagagatgagaaagctcaggcttaaagaggtaaggtaacttgcccctaatcacacagctgtaagcagcagagctgggatctgaatcccactctacctggctccaaatcatgcactcttcttgccacatcatacctcttccatagggctgtccatgacctcctgctggaagcgcatttgtactccaaccatgaagggggtggggcagcagacggtggccagaaggctctcagggacaacagggatgtaggtgtgcgcccagctgaaggggtagagcagtgcggcagcagcatggatgcactgagacaaggtgctgggacagagcacagaggatgagagtcagggggcccctgcaccaccatgctacacacccctcatcgcccaccaccaacagcagctagagcagtgctgcccatgcccatgggcagaaaggcaagtctgggggccatgctggtcacagagcttgaacgtacattgctgggagggagggacagaaactagagagtctgaggcttcactatcaagaagggccttgatttgacccttcttttcccagttagtcttctcaacttactactggccaaaaataaaagtgactctgaagagaagagggaagaagagttgctttcattcaaggagataattgattgagcccctagcctgtgctcacaactgtgagcatacctcacagatgtggataccaggaagagtaagacactgaccctgcttttaaggaattcacagtgtagttaagagacaaacatgtaaacaagcactggaggctcagccgagaggcaaagcctttttacctcgctatgtctatccaccctcatccccagcctttgcccccacacagccccctctgggcacactcgaggttattaaagattaccaggttgctgcctgagtagcttgggaaattcccaggttctaggaacctctgcccagcaattcctacacggaaagtcccacaaaggtgcctcctcaagactttccagtgaagcatttctcgtcactcctgcccaagtcacaacttggaccctactcctctcgccaccacatacacacagtcccactctctgtctttctcttttatcccctggctttcatggctcttctttactccagccaaattgcctcaaagtcaaggccaataaaagcacagatgcgggaatccttgtttcagttctgggtttcaagctggcacttcctgaattagcaaaattgagtctctgagaggctagctgactggaagtcccctccctgtccgagcttcagggagctgaaaaactcagtgtgggaaggaagtggggagtggtgggatttccctgaagaaagtaaacgtctgagaggtgaatcctgccgacctccacttcccaaacactgatctgaggaggaaaggcagaatcccagctctagccacacaggaatttctggtttccattcaaggctgggagtgaaagagctatttccaaagcaaaagatgatgccactcccttcaaggattacctacaactagttcctctttggttatcacccatttttacagaatcttcaacacagagaccccactgcttgcccaagtttcctttcctctgaaacccatggcattcacctgcccctctgacttctgttgagtccctaacatccttttcttcttccctaaaagataaaagcagggttgtcaacctaaaatcactggttttctccctccccagatatgaatagaaggtctacccctacccctactgttttatgacttctttcattctccattctattacatctccccacgtccttctcagatctgaagcccctaaaaggtagagaccatggcacaatagtaccctgcttccactatacacagggatatactcaactgtgaacttaagaacagaagctagcactcagcaatatgtgctcagcagggtgttaggtacctaatgtgcattatttcatttaatcctcaccacaaccttatgaggtaatcacaatcattatttccatttttaagaagttaacaaactaacttaatgggaacctcatagctaaaggtagaagaactggatttaaacctcctaattctgctgatttcaatccctgtgctttcaaccagtatgtaattccgcatccccttcaggtgaaggaccttgtcctgtttgtatcttcccaatgcttggcatctggcaaccagttgacacacaataaatgtttgttgaatgagtatctacctcctgccctgttctccaccctccctcagccttgcaagggcagaatcatgtctgcatccaccctaactggtcccacccaggctgtcccaggaatacttcctgtccttccccaagctaagtcaggagcattcctcaggcccaggcagcagtcctgtgtggaggaagaggcagtgggggtggttcaaaacagctgtttctcttggtttaaagaacaaggagctagaaacaggagggtgggcgcatggaccctacagcccattttccttggataacctccagtctgttcccttgaacccagggatgctgggcagttcaggtgagccgtccaggggctgggcccacctgagaccttccgccaggaagatgatttttctctccagcacggcagaggcaaagatctgaagtatctgttcaaaactgagacagtgcaatagagaactaaaatccacatgttctaggtgggagtccaggggccgtgtcagtgaaatgaactgtggggaaaccagagagagagaaggtgtcactatactgcaagatcatgcagaccccgaggtgctaggcctctaccagcctctattccttctgcccccaggagtgaatctggccctgtctctctgtccccctgctaattggctggaggacagcactgatgtgatcttgagtatggcccataatgtcctgcaccctccctcactcgcctccccgagcacacgcccctctctcactgtgcttcaccacatgggcttctgttccttgagcaatcccatctttcctgcctgcagccttcacagtgagggccctcctcctgcactgctctgctcccttcattcttaccctctttcaggtcacagaggcccccctttggccatgtgatactttcccatcttcttatgtagcaccctgttttgtttttttttctttcatcacagttacataatttctaattcaacatgcactggtgtgtttatttaacatctgttctccccactggacttacagctccaaaaggtcagggaccacattcattttggtcaccactgtattcccagaaaatagtatagcttggcacacagcaagcattaagcacttattttttgagaaagtgaaaatttctagcctctccccttattttcctgtggggaagccaaggttcaaaggggcacacagactattcagagttccagaggacaggactggaattcttagaacagtgttctacctgctgcctcagtgtgcttggtgccttaaaacgatagcattcccctgtgcatgggtggagactcggaggtggggatggatgataagaaatggacagatggacgctgtaaggtagagacaggacaaacaaaggagagtggaaggggggtagcggcaagtggcagtctgagggctgagggaaaagtcctttatagcaccagaagcctcaacttacatggtttatttattataaataaaagtcttggtggcttgagcagtaactaggtgcttgtgggtatcaagttagaaggatcagaaaatctgggtttgatttcagctttgtccattctaaccaagtcccagtccccatctggctcagtttctctgtactttaacctggttaatggaagaacagtggtgagaggtgccacagatgcctaccctctccagctagggaaggtctcacccattttgctaacccacctcagtgcctgagtcggggatgaagctcttgagagtgacagtcttcccaggagcagggaaggctgcctctcggaggccctgcatgaacgggtagatgacagccatggagatctgatgtctcttctccacttcatccaggatctgcagggaaaagaaccacgggaggcacggctcaaagggacactaccaggcaggtggaagagactctacttgcccctgagcgtcataatgttctcatactggttcagctgatcctcatgtatcttctagggccctccacgaactggtcctctccctccctggcagaggctgggctcatgctaaataatctgcagtttatctcccacataagacctgccttcttccagcttcctttttattatctctctacacatccatattcttcccctctcctaacaccaacataaaagcacctccctgggaagtcatcccggagtaaactcatcacccatgatggtaccatgtccactcatgctggttggagcaggaggctagaaggctaagcctcttggtaccactctgtcctccaactcccactgtagattcccgaggtcagagactgcctccatccctaggagcactgcacaaaggaatgctctgcccaagcaaaagctgacagagtttcctcccctcctcctccaaaggtcctgctggggtcagagcataatgaagtcctttctggtcaccagtggatggcatggcccccatggattctgctcaaattctgtctcagatgcactggcactcaaattagctccaagagaagtcctggggacctcaactgttcttctacccttgaaggagtcagaatgggtcttataactccttcatatttgtttagtgctctgccttttataaagagtcttctcatatatcacctcatttaagcctcacgccacccagtgagataggaaggtgagattattatatccattcgacggatgaggaaattgaaactcagggcagaagtttcttctgcttgtcctacttcaactactttcttacttggctagagtgggaacagtagctgtctctgcaagaggtccagtcccctagattcaatttccacttttcccttaagtcaagtgcatgcccctttgcctcagttttcccaagtgtgctttaatgctgactctggctatgggagaagagctccactaagagcttagttgcacaggcagggttggcagccagagacagcctggaatatgggcaggccctgaggaatcctatccctaccttggagaacaagccgaagcagccgatgcagctgatgatgcagtacactttgggaaggcgagggccagggccggcaggctggggagggacagagaggctccttcagtgctgcagcctccccaagggcttctcccaactgggtatgaaggagcacaaggctgagggctggggagggggatttatggggaatggtgggtgcagcagggaggtcagaatggccaccagcatcaaaagaagaaatccttgagggtactgggtgagttggtgggcaagcgctgccaccttcagtgccagcacaatctggggtcagcaaagaggggtagcaagtgtgccttagagatgaagaaatggctaaggaggaaagcactgtaaaggtgacttggggaatcctcctgagacctaagatttgaaactaattgtccaagtcccagcctctgctctgggaggctccaggggccaaggtaagcaggcctggatagagcaggcagggagaggagttagttgtattgaaagccagagagagcacagaccagagcctgaccagcagcgggagaaggggcatcaggtcctcgtgcttgtggggctgcagagggagcactagcatggcagcaggtcctgggctgtgctttttctacaaccagtgctgccaataagcccggagttttgcagctcaggcttgagcaagcccagccgtggagctgagcagactgcagaaaggaaggggcagttctgagctgcacagaccaagaggcgcctgcagtatccaatctttctgctcccatccacattggtcagaacgaaggagaaggtctccctaagaaagagcagacaaggcttgatttgtattgctcactgaatcctaaaacaggaaagtggtcagcactagagggtggagaggagggcaaaggggagttgctgattaatcacaggagtaagggctcactggtgtcaggccctaaacacatcatctcatctaattgtcaaaacaactctttgaggtaggttcagtaattattcccactttaaagatgaaggaactgaggccagagggtgcttcttattcaaggtcactcaactcataaatagtgaagtcaaagctcaagcagtcaaattccagggctcatgctagaagggcctttgctacgtcgccttcttggaggctaactgctttctgctaagtccagcttgggccagtagcagagttaaaagcagcaactattgcttctaggacaggtgggagaatctggctctttggacagaagtgactgatcaaactgatagctcatattcttggccttgagggaccccaggccagatgttttcaaacaaatcaattacactcccaggccgaaaatcaacaaatgacagcagtgagggaggctacaggagccacagaactcacacatgttccttctccccaaatccaatacccttgcccagggctgagcaattacctgggatactcggtgagtgatgcccactcattcccatctgggaagcagaacaaggggatagctttgagcagccgctcctcctcctcctgctgaccccgaagcaggttctcccgctataaggcaaaggaaaagacaagtggatgtgaagctgggggcagagatagcaggagacagcttcagagctggtgggcttcctttgaggctctaaagcagtctagggttaagcttctccactagcataggggcgaagggtgcctttgcccatgactctgcacagtttgcattctgggtccagttggaacaactccaaagctgaaacagcccctcctgggtcaactctacataagcttgagttcgacctcagtatcgagatctacatagaaaggggacagggccatgttgaatatagaaaggccctgaaatggcccaggcccctgggaggacaacatcagagaggtaccacatcagagaagagaagcggccagctcagttggcacacctgctaatgagaaggcttcccaaccctctacctggtgaaggatcagacaaggagtctaatgcttgggctcgggcagagggctgtgcctgcccaccagttacaaggctgccccactctttccttcccacacatcccagagaggggattcattctaggagttctggcagaaggtaagcttctctgcagagaagggtgactgaaaatgggatttggaagacctatcaggtcccctaaaaggcaaaatgtctagcctagtttccctgctaggaagcctaggtcagtccctcacaaagaagttagacctagattctgtgggtgataacagagaactggggctgtgctaagaaggaaatggagagcagtgagctcagagctcagggcagctccaggctcaagccccggtagggtagggagaaggaggtggaacccccacccctaccaccttccaaacaccccagtcctctggctggccctgcccctccttcagtccttaccttgggaaattggtaggtgattataggctcgtaatcatcctctgaacgcttctttttgagagaaaccacaagaaggtattcaaagaagtgctgccccccagcaaagttgggcaaagagtgctcctgggccctttctggttcctttaaagcttcccctgaattgtcctggggtggtcctgaaatcaagccagagcccatttagtataatctcattgatccattcctggagtggagtctgtgagaatccgggtgacctccacacctcaaggccgccttgccaatgctgagatacctggatactggccagaaccaccagtcactcaggatcagggccaaatgggcagtttccacacctgccctggtagacttgaaaccatggggagccaagcagaggaaagaaaccactgacacagaagccacggaaatgtgctggagaggccacatggaggccaaggccccagggtaccacagagactgcctaacctgtcgggtgcttctggcagtcctggaacaatatggcctgagagtttagttcatactaagtgaataagaacaggctcaaagggcatgtgactgtgaccacactagccccagagagggcatgaccagctcttaaaaaccagcagaggaagcctcctgacccagtcacatggggaaccatgtggaggccgagatataaaggaagaggaggaaggagcatttcaaggaagaaacagtcccgcctaagagggtcaccctaaaaacaaggaagtaggcagtccagtcctgacctgctcggagttgaagcagtcggcgttggaagagcctgaacacccggcctaccacttgtccttccatctctgggccttcaggacagagcggactcccctctcccctaacacagacagactggtgacagtaagcctgagaaaggggctgcttcggtctccagccacaactctgtgaagccaagccacgcgctgtcttccagagagggaatagaagtttccatcctgtgcacccagtggttgagcaagaaggatgtgacgggacccaggaaggcagcagaagccagcaccaacagagtcagcatcctggcactgcagcgcagatctcagctcctcccaagagccccagggtgtggcgagagaaaaggtcatgagcaaacacctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagttctggaagtcaatacccaatagccttctttcctgatggtgcagtagagagcaaaatccatctctaagcccagagttcgtgatattttggaaatagctacaatggtgaatttcaccccctggagagttctgtcactggcacttgttccagggttccagcagagtccctcttctcaaataggaagcactggctcagaagactgtccccagcataaggtaggggactgattgcaccagcagcctgagggtgattccatggcagtggaaaacatctgggtgatctccacccaacccccacgcctgctcagccttcctccgggtcaggccaggtcagctgttctgcccaagctacaggcacagctgctagcccactgctgtgtctggagactaggtaagagagaaggaatagcaaaaaaatcaccttggattctcacagaaacccctgaatgagtaaatacagggaaggcttttaccaggaagctgcctcaaagggaaagcagggggcaaaagggtttgacgccagtgtttgccactcctgctaagaataagcacccctctggaagagagtggggtgctaggatagggaaaacagctgctttgctcctaagagctctagacctggcttctgtgggactagaaaaagccaggactcacggccaaactcatgtacagtaaagaaagatgttcaaatgctgtaatgggtgagaagagcgaactagaacacttggagctggcaccacaccttacttgcaagctgcacagacttgttgcacaagccttaccacctgtttgaggaacaagcatcttcctgatacagatggggaaactgaggcataaagtaattcaaaggctattaaaattgacaggatttgttgggaatggggattaggaaagctccaaatccatgctcctgccttctggatgcatttgacatcaaataccccacagaggttttcaaaggacattgagaaacagaatcttatcactgatcattccagattctaatgaaattatgcctttccctaaatcctttgggctgcgttttcagatcattttcttctgctttatcaagcaagccaagagaatagcaaaattaataaatcattgacaaaagaaagtaattagacttttgggatgaggcccaagaaatgcagcaaaagactgttttctcccctctttcaaaaggtgttatccacaggagagaaaagcgtaagagaaaactaacctccatcaaactcatgtttcatataaggcatctcatttaatctccagtgccctagaaaggaattattattcagagttttagttgaggagggagccaccctttctagggaagtcaggaatctggttacacttgttcctccaccagaaagcctctcccacacacacctgactgaagtcccagatctgtctagaacataggtgaggggaccttctggaaccttgatctgggaagctggcccatcccttccagctcagctgctctcaacccaggaccaccaccacatcactccttgtcaccaggatacacacacacacacacacacacacacacactccctcctaatacacaactgtcctggggccagaaaggcaaaggaggaagggggagaatccccaggcaagtggaggatggtatggaagatgaagagggcatatgctcctggccctacaagtgttaggcctcagttcttacagttcctcagtatcaggaagctcctccaggcacaatcaggaagtgcctggtgttggggcaggggtgggtgggaacaactggaatgtctcctctgggctgcagggggcagaccccttccattcacacagatgtcccagggtctgggaagaccaggacagaccaggccagtgctctccagagaagagagaatgtcagcctcatcctgccttctgctcccaccactgcacggtcccaggcctctgccccaaactgtggtctctgacctctccctgatggtgcagatggaatggccagatattggagatctgtgtctagagaggacactacaaagagggaaggagcagggtgtggcaggaggaatggcaacaggaggaagagcagatcactcagaggtcactgcagttcaaagaagggtgcactgacctcactccctgaggtccccccaactctggggcttgggctaagagaggggctcacttggcctcctggcgtgccaatgttggaaagggcaggttgtctgggaatggcccctgctctttgctcctcagacagtaggacctctgggcaaagtatctaagggtcacggctgttcagccataggactggctagtggtaagccacacaaatatttgccgagtgaatgaataaatgaatgaatttctaactgccctccttccaaccccagggctctgctaagaaagaaaagaaggtgcttctttaacttagaagttgacttctaatttaatccccataatcctggacgggggaattatgtccatttcactgttgcggggctgagggaaagggaaggggtgccctgtctgggcgacacgctggaaagcagcagctgcgcaggttctaccgccgctccgctggaggccacactctgaagggcacctggccgagggtgggtgggggtggtaacgtcatcggggagacctgtgtttgtggccggtggctatctgctgggcaggggcaggggcgctggctccgaggaactgggcaaagaccacggaggactcccagggcggcgaggtggggcggggcggcgggcacgccgggagctgaggcagtgcctctgggaggacaccacaaccggggcgctttcaggcacactgcggttgcaccacaagcttcctggatggaaggacacgtggccccggggccccacaacggcttcctgtgtcccgccgcctccccctcgccccctcaggcctggcctcgccgtccccgcccccacctgaccctcttcccctctccgcgcgctccttcccgctcacctgcccccgcgcagcctcctgagtccccttccaactgctcccggatctcgacgccccgtgccgccctccaccgggccccagccgccagccctagccccggctccccggtgcccacgccgtccccccgcgctctccccggccggcactaacccccatggccgcgcttcagtctcaggctggctcgaaggcggcggccgagcccatccatggcccctggagtgcccggctcccgctcccagctccgcgctggccccgcccccctatccttgacctccgcgggtccgacactttcactttcacgcggggggaggcctaggggacaggttcggggcggcgcggcgcaccttccggactccggcccaacccccgggcgcacctgggcgggcccgctctgccctcgccctgggcagggcagcgtggggtggaagagggcgctcgacgcgcgtccgggactgggcggcgccacctcgttcccaccctccgtggggctcccggggaggcttgacttagcgaacaccctgcagtccgcaaaagcgcatgtcctggctgaaatcaccgtcttccaggtggccccaaacgaatcccaaaaggggcagagttttcagtcctcacacctctccaacccctccacctctccctttgcaactgctttagcccttcgaccatctccaggtctcttgccctacttgtcctctcactctcggagttcctgaggaggaactggagatgcggattagggacctgtcgctgccttccattcaaacttggccttgagcagaccagcaaaatgggggtaacccctgccattccacagaaatgtgaaagttcaggaatagaaaactctttgtaggttgttacataatacaaatttaagggactgttattgtcataattgttgcagctgtcccctctccccttctaatcctgaatttcaatgcagcctttccgctcctcccttttcacatcttcattgacttccaaatacgtccaggctgtaaacttcaggtatcaaccatgacattgtgggtctgctcagcccacttcctcctgggagatctgccctagttccccgctccctctcaggacattatctgtagggctgggaagtgcagagtccatctggggttgcttggtttacaaggttttagggtccttttcaggagaggtaggcagagggaagaagggactctggcagaaatacgtctggaatctgttggcctgactcccagacctacagccctctttccatggcctccaggtgactctccagtcaccatgggagagccggaattgggaatccagccctagtattaactgtctggtcttagcccagaggttctaaaagttgactttactccggccgtatgcaattttgcacttaattacagtctgtttctgttccctattctttgtgtattccctcacacaagtacacttcccttccccaagtaccttttctgggctgaacccatgtcttatgcatctctgtgtaagaacagtcgttgctcatgataaacttgtccaattgattgaatattattgtgccttaacttccccgatctattttgtggtattcccaaccaaactaacttcctttctttaaaaacagatgaggaaaactgtgtacatgtgcaccaaaaagataagtacaagaatgttcaagggagtcttatttgaaacagactcacgctggaaataacctcaaatgtctattaatagtaaagtgagtaaatcgcagtatattcacataatgaagtactacatagcagtaaaaataaataaaccactgctgcatgcaataacatggctacattgcacaaacatcatgttgagaaaaggaagccagacacaaaagagtacattatgtaagagtccatttgtataaagtttaaaacaggtgaaattaatctatggtatgagaggtcagaatggtgttacctttagggaggaaggaggaaataatgattgggagaataccatagtgtttctaggatgctgataatgtcctgtttcttaaccaggtgatagatacatggatgtattcactatgtgatcgttctttgcagtgaacacttaagcacttctctatatgtatatgagactttaaaaagatttttaaagtattcgttaggatgttagggtgacattaatgaaggtaatgaaacaggaagaagttagttcagaataaaactagaaattattgggatgggaggaagtggagctaactaagtataatctgcatttttgagaagtgtggataataataggaacaagttaattgatccatagtggaaaatttgggtttaaagtgatgggttaagatggcgaagatgagagcatattatgggtatagcaatgagaattagcaagggtagacatttaaagtataagaaagagggtgtgcagatggagcagcgtctgagagaaggtggggggcaattagaagcttaggtagaagtttggctttaaatgggaaaaggaaacttttttttttttgagacagagtttcgttcttattgcccaggctggagtgcaatggcgtgatctcagctcactgcaaactccacctcgcgggttcaagcgattctcctgcctcagcctcctgagcagctgggattacaggcgagcaccaccacacccggctacttttgtatttttagtagagacagagacggggtttcaccatgttggtcaggctggtctcaaactcctgacctcaagtgatctgcctgcctcagcctcccaaagtgctgggattacaggcgtgagtcaccgcgtgtggccgggagaaggaaactttatctgagggaaaaaaaagatgaaaatggctatagatgttgataaatgtgtagataaggtagcaagaagttaaaggataccacaggaggcctcagtttctgctaagacaaaaggttctttttcttcttgtagctgccatcttccactgtcccctgggtcattctcctagtctggctgtagagtggaagtgaacgaccctagccttccttttttgaaggtcttgaaaggaagcacactaataagttgtattcaaggaggcagtcagtatgacataacagaatgagcctgggcatctgacacagacgaacttggacctgaacccactctgcctcttgtttgccctgtagccttgggttaggctttgcactgagcctcacttttctgatataataaaatcaccttgcagggcagttgtgaggattagaaagaatatatttgtaataaaaatgccaaacttcatacatacctttaatcctcaaatcactgtagtctcagctccatttcttttaattgcagaaagcactgtctattaccaggcttgtatctccaggaatttctgagaaacctcaagaaacacacactccaaagaccaattctgatattcactggtcattagggtccatcatgggaattcaaactattactttcccttccacagttatacccatttgtctgaagacatactgctattgttctcccctgtgccacactgcccaacttggacaatgattctatcttcaattccatatagagatagctgaggtcagaagaggttttgttaagacttagctgaaggtttgttaagactttgttttatgataagagaagcacgttataaaaggaaaacttaaacacaaagtatcaccactcttggggtctgtatgagggtcctctttggagtacttctctccctacccctagagctgcccccatcttgcagggatcagctaacctgactccagtgggaatgcccttgaacgcagccctgtctcagtattcgcatattcaagaatgactgacaagagcgatgtttattacattcacggggaaaccctgtcccatacttagaacctaatatcttttggcacagagataccagaacaacaacaaaaacaaaagcaacccatatttccccaagaataggcccatcaatacagaatgccaccatcaattggcctgcacaattcctcttcctttgagatgaacaaaagctcaagctgtctcaaactgtgtatactgcaagccatctgaaatttggcttctcatctcctgtgagaaatgagttgaataacctacccatcttccagaaacaagcaatgatatccaggattaggaaagaacatctgtatattagaaacaaagatagccttttctgttaccacaaagagttcctggagttaaaaagttctcaaatctctgtctcctataaagggtctctgctctatatttgatagccaaaatcttcttgtattctctttcttcccagtcttctaaagtgctaagttttcaatcccaacattttgtgtgtgttgatccctctgcttggaatcttcttcctcccactcctcactctactaacttctactcattctttatatcttgcttaaacgaacttttctgaaaagacttctttgaccacctcccctttccatctaaatcagatcctcctgttacaacctcaatcacaccgtttccttaggagcatttatagccatttgaagttacatatatgtatttctgagattatttgttcgactactctctccctttctagagtcatccccaggaggcatgagtcttatctctttcacttacttctgtgtccccatttcctaagcacagtgccaggcatacgttagataaacagtaaatatttgttgagtgaataaatgtatgaattaatagatgggtagtatgcagaaagcttctatctctaaggagacagaaaattaatttaaacatttttttattttctgggttctactcagggcaaacactttgggtgcctaagactcatttccccttttacccttgctggatatatggatatatttgctcagaggtatatcagatggtggaatctgatcgtggtagtcctggtctccttcccccaggttgactcatggtggccatgtgatccaggtgtggccagtgagaggtaaggaggtatctaatctagtaagggaggcaagaggcaatctcctagggacttctgggataggattctccagaagtgatgctgtttccctgcctctgggcatcactgggtttggatatgatgacaggaactggtgagatgaagccagcttgtatagcagaacagggacaacaggctctcagggtaatggggcaggagtcagggatggcatgtcaggcctgaagctgccttcactctgcactgcttgttacctgaggtaataactctccttatggtttaacacagtgagccttctaaatacattttacatggcatctcagtgccatgtaacatacacacatgtaatatacaaataaaagtttcacaaaacaataccattcctactatgtgcaaggtatgctgatatttctcctttttcttccattctactattgcgcttttaaaaccatccttgtttgaggcaccttaaaattatttcacccccaaaatgtgttgtgacccacagtttaaaacatctttgggttttctggtactttttctgcacactctgaagccagactatctgagttggtgtctcaggtctgccagttactagtttggttacgtcaggcaagtttcttaacctctttgtgattcagttttttcataactgatagaataataatggcatctaccttacagggttgttttaaggattaaatgagctaatatatctaaagcgcttggaatgggaagccattggcaagtctgaacacaagacttacatgatcctacaaagatgagtaaggcatggtccttgttctcacagagtttgcattcttgcaggaataatataatgcagagatactgggattaagataagcacgggtagttcaagatcatgaaggagaaacacgcattttagcttaagaaatcaagtctgatctccagtaggtaagtctgggagataaaatctcactcacttttttttgttaactaatagactagttttagatttacagaaaaatcgagcagaaagtacagagagtttgcacatatcccctcaccccacccccatatatagttttccctattattaacatcttgcattagtgtgggacatttgttacagttggtagaacaacattgatccactattaactgaagtccatcatttacattagggttcactctttgcttgtacattctatgggttttgacaagtgtacaatgacatgtattcaccattacagtattatgtggaatagtttcattgccctaaacatcctctgtgctcctcctattcacccctccttcccctgtcccactccaaaacactgatctttctaccgtctccatagttttgccttttccagaatgtcatatagttggaatcatacagcatgtagccttttcatcatacaatatgaagccttgcgtcttttaattagaaatgtgtatttatctttcaaaaccctctctgaatgcaaaatacattcataagcaaaagaacaaagagtaataatttttaagtgtgttttcagcactgttcaggggattgagcagccaataggtgtaaccaatttccttaacaagcatctgcttaataaatatttgttgaacaaatgaatgaatgaattcccagcatgatgactacattagcagatggtcaatgcatgcttgttgaattgaactctagacctaacattttgattgcatttgggggttcccagttctccttgacaataaacttaagaggaacagatagttctcatggcttggtcactttatatgtttcaggcagtatgctaagtattttacaaatattaactcaaatcagcattatcaataatcttttgagctagctattactattcccaatttatagatgaagaaacaggctcacagatgttaaggaacttgcccaaaatcacacagcaggtaaagtgaacttttaattcacactcagatggaaactttatccccaggagcatcctgatgagcccaccaggacatgtcgtggagtcttccatggagctgacaagtgacccagcactccaagccttccatgatggtctcaaatagatatcctatgagactacactcaggtctgtgtagtgctcccaaaatgccctactctgctttctacactgaacaatgccccaaagtggtggaattttttttttttttaatggaagccagaggttcatcataataggtgtcatggaagtcctcagagatgtaaataaccccctagagataaggctgacatataaaagtctacctcagtcctggggaaatgagcacaccattcaccactgtaggagaaaagaaggggacagaagatcatgtagggctttgtaattcatcaaagattcttagacatttcttttttttttttttttttttttttgagactgagtcttgctcagtcgcccaggttgtagtgcggtggcgcgtctcggctcactgcaagctccgcctcccgggttcacgccattctcctgcctcagcctcctgagttgctgggactgcaggcacccgccaccacgcccggctaattttttgtatttttgtagtagagacggggtttcaccatgttaaccaggatggtctggatttcctgacctcatgatccgcccacctcggcctcccaaagtgctgggattacaggcgtgagccaccacgccaggccgattcttagatatttctacctacaattggaaatttaaattatctccaacacttcaaacttctgacagataagatttataaatctaataagcagaatctttgtaagcatataactaagtcttgtaaatcgaacatacccacccgctaaatgtgctaagcagagagagcatcgtcaaagcagctcatgaggacaaatcaatttccttgaatgaacacaatttaccaaaagtattgatcccatttttatctttttattgtctctctgcttgcttgtacaatttcccagaactacacatttttcttatccagataagggagactttaaaactaggtcagtcacatgagtacagtaactgacatttcagaatcagggtttggtctgagactctggatgggaaagcaaggcctgagcattagttccaagttcattctagatgagccatgagttaataaactgaacacttcttgtaggaatacaacttcctaatcatataccttttcttgcaatatagtgcatcctttattactttttggcttttttgaacagtaaccttttataacactttaccaagatgtctttttataaatttttattgaataatttgaattaaaattctcttcttcttaactgaattgcagtgaaatctttctattgcccacctgggtcctacactctgttcctctgaaccttttgtgtttattaaccactgctctctggccatttattgacagaaagaatctggaattttagagtgtcgagttagaagggacagtatcagaggcactcatgtgcccacctgtccaccccccgcccctgcccccaccactgttcctgctaagtgctgggaactctgcctagcagtttcaacaatgggaaaatcctgccttgagaaaatatgaagcctgccgttccctggcctccctggctggggtgtgaaagcttgtgattatacagccagttagtggctgtcaggaccagaatccaggaaatgtctctccaagcccctatcttcaacacaagaaggagatctgatggataactcttttctattttctcccccgcccccccccccttttttttttgcttgatgagcagagatagacaacagagaacagtgagcccttagctcaatcctgaaactcagaaatcagaacatacttgttaacagactgattaacaccaccaacccccacctgtcctggttgccctaatcacaaactccaagaaggaatgatgcccacacccccacagttcttttcctcttccctcacccctgcacaacccaggaaggtgctcagctgagcaaccacagcaggcagaagggctgcctgctaagtgaccatggcatttaagggaagccaagaaagtgacgaaaggcttcgaaagacaactgcaggaagaaagaaagaaggtcatggtggacaggatcctggggggaagagagacatggtcaggtggagaggttgggggcggattgccatcaccctcaccatgttgcctacttgagtctcagaaacaactctcttttccttccctttgtgctcctgcagagaatatcattccatcttacatcttattgttagtagtggcaaatccgtacaggtctgcagcaacctcgattcttgcctcctcagaagaaagattttgactgaggggaataaggcagagaaagagactgaagcaagttttagagcaggagtgaaagtttattaaaaagtattagagcagaaatgaaaggaagtaaactacacttggaagagggccaagcggatgacttgagaggttagagtgaatggtttgacttttgacttggggttttatatgttgtcatgtttccgaggtcttgcattacctctcccctgattcttccttcagggtgggctgtccgcatgagcagtggcctgccagtacttgcgagaggccgcatgcacagtgtgtttactggagttgtgcaaatgctcacttgaggcgttcttcccttaccagttgagtattcctagaggaaggtcatataccagttaaactctgccattttgccttttagcgtgcatgcttgggcccactcgcccaactcctgagatcttattgggaagctgctgatcaccaaattttgatgttttctatctactgggagattgcctttccctggtgccagctgcgacaaattattattttagagagatagtcaacaaccgcctgaccatcacctcatggtcacctggcattcctggtttgggggcccactcctgccctgctcatgtctgcgtaactacctactgtaacatcatgttttatttaaagagatagatgcacaaagtgtatatatgtgtaggtgcccacatgtctatttaactgtatgtactaaattaacatctgtccccaaactgatctctgctgaacagagccaatcaaacttggttcccttgttgagcttgcactcttggtattacatacggactaggggagagggccagcctcagcactgatgttacagtctcaccaatgcaccacaaagtagcagtctctcactgtgagttatcacctggagttctttttctcacaactaagagaattagggagagtgagcacaaagggtgaagttggagcgaaagtttaataaaagaaaggagaaagctcttggctgcggagaggggacccagaaaagggttaccatttttacagttgaatgcaaaggtttttacaggaaaccaataagggctggggatctcatttgcataggtacgaatttctggtagctctaccttgttcttctaatgcacatgtgggcccttagcttgagttactccgtattgctttgttccccttactgtgcatgtgtcaggggatggaattgtccgttgtgggcatgtctgggcaagccacctgtatagcctttcttatctgtgtggctgtgggcatgtcttaggcaagcccccctgtgcaaattcctttatctgtgcctgcagcttcatttttcaggctgttcttttgtttgaaagagaacccaccctaactacctgcctgaccagtttcttcctttctcctccctcactaggagatgctcttatcagactttcctaagtgtcaaaaaaaaaaaaaaaaaaaagccacagtctactccatcttttctccacttctttgttcacttatcatcttactctaagaagtctttatgtagctatcatttcctgagcgtcacactgcttggttctgggaatcaaaccacacaaaactgaactcagctcataggacataccatctgtaacccaaaaataaaattctaacccccgccgccgccgaccatctgaatggaccccttttctcagcaagggcattccaagagttacctgagggactggttcaggccatgatggggggtggagtgtggacatgcctcatcgtacacgcctccctctcagaacagactctgaaagtttgatgagaaacagttacagtcaattctttctgaagcctgctacctgaaagcttcatctgaatggtaagacttcggtttccacaaccccttattgtaacccagacattcctttctattaattccaggtctttagataataactatttcaaccaattgtgaatcagaaaaatttaaacctgcttataacctggaagcccccattgcaatccccccacttcaagttgttcccccttttcagaccaaaccaagtacatcttacatgtatttgattgatgtctcatgtctccctaaaatgtgtaaaactaggctttgccctgatcaccctggacacatgttctcaggatctcctgagggctgtgtcacaggccattggtcactcatatttggctcagaataaatctcttcaaatattttacagagtttgactcttttccatcgacatgtttcagccctttgagttttcacaaccaacgtaatttgcagggtacttgcaaacaccaacagatattttagatataaaaatgctttaaataattggattatttgagctaatattattgccatatactccaaaggtaaaacagagctcactagtgtccttgcaactgacaggaagcagaatatagtggtaatcagcacccgatgggatgcctgagagatgtgaggtctgagcagccatcacgttgtagagttgtagagaacgtgagaaaccatgggcaccaagttcccagggtgaatggggctgtgcaatcactgcttcattttgcttttgctttcttccccagctcttctctctctctctctctctctctctctctctctctctctgtctcgtgacacaaaggaaaccaaatgcaagttgatacttattctatagggcccagatactagtctccttcttcacaggaaatggaaagtctcagtaaatctctcaacagaggcctgtttgcaggaggccggggcctaggaggtggagctaagtttgtttatcagcttgttctggggacagaggtggaaccatcacccacaaccagaggaaactgtctggttccccaaggtcattatgggacttcctgccagagcacctgatggaacagttcatgactgaggtgggccctcaccttaaactctttccgtagacagaagtgggggatgagagaattcgtaaatgaccaactaaccacctctcaggtcaaatctgaactccctggtgacttgagggaggttttgtgcagaaaaagcaccaggcctgccaggcctgcaatgcagtcagaaattgctgcatgtaaatcctggccctgccatttgaaagttgctcaactttttccctgtaaaatggggaaggctataatgtgcactataccccggtgataagggttatgtaacttcctctcctatccattttcatttctcccctttccttcccagttcccaagatcccattatccttcctcttacactgacagccaaaacttaaaattctgcttgctttattttgcagagcaatttagttttctttgtttcattttttcctttcaagacaagattctgggaactaatttttcagaattaaacaaccacacaaatgttttgctaacacacacacacacacacacacgagtcccccaaaaggacttctgcctccagctttaaaacacgtgcattttcttttctcactgtattagtttttcagtcgatacttcccttgtttctccagagaacctaaaatgagcaagaccaccaagctggtccaccatcctctacatggacttcgagagtccccagaacactgctttttatggccatttgtataatctgaaatggtgccccctccatgcccctcccatgtctttcaatcagcttatttgtaaagtcttccataatcatagtgccattatgccgatatcttataaaaacatgtttattacatacacctgccaaacatgggcagcaggtattttgcaataaaagtgaaaaaagcaatcaacagttgaaattgttcatcactagcccaacatctttcctatcacatgccccttcttctctgctaatagaacccctatttgctaggtatcggtagaaatcctttgactttaaagagaggaggcctcctaccctcaccataatgcatgaattgtaattcacctaaaccacacatagtaatttcattctcttataattggtcatgtgacccaatgagctatgaggggaagtttgctgaatgtagtgcccaggaaagcttttgctttctgggcaaaaaaggacagactcaactggtagggtcccttttgctcctccgccatttcttctttcctgtaatactgacattacgcatggaaatactgcagcaatcttggaaccatgaagcacaaggaaaagaacaaagaagcaatctatgaaactatggcttagcagaaagatagcaagaacctgggatagttgaaaactttgagtagctgaccagccttggtcttaccagttatgtgaaacggctaagccctcatttgtttatgtcactgtagctgggtttcctgttatttatacttaaatgcagtcctaataggtacatagtgcatcctctcaaaaatggttaaaggctcattatatacacctttgcgtcagccttgattccacatctagtgcatgagcaagtcctgtctgctctaccatcaaaagtgtatcccagatttcaactatttagtacttcccaccacccccactgccattaacctggctgaagccaccatcatctctcactcgtaatgcagcattctcttaatgggccacttgagtctactcttttcttccttcagtcttttctcaacatggcagccagaatgattccattaaaatgtaaatcagatggtatcatttctcttataaaagctctccaatggtgcctctgttacgcagattagaagccaaggtccttaaaatggactatggggcacctacctgattgggctcctctctgtttttttcatttgttttgcttttttttgtttgtttgtttgttttggttagatactttctattactgtcttcaagtttgcttgttcttttgcaggatctaatctattaagctcactcagtgaatttttaaattttaaatctcatattttttcagcttttcttcactttttgtttaatttttcataatttctacttctgtcttcattatactcatgttttcctttaaaccctcgaatgtactttttttttttttgagatgaagtctcactgtgttgcccaggctggagtgcagtggcgcgatcttgacttactgcaacctccgcctcccaagttcaagcaattctcctgcctcagcctcctgagtagctgggactacaggcacctgacaccatgcccagctaatttttgtatttttagtagagttggggttttatcatgttggccaggctggtctcaaactcctgacctcaaatgattcgcctgcctcgacctcccaaagtgctgagattacaggtgtgagccaccgtgcctggttttgaacatacttataatagctgctttaaaggtcttgtatattaatatctgtcatttctagatctgtttctattgacacatttttctcctggttataagtcacatttcctgttttttggtatatctagtgattttttttttaattggatgcttgacattataaatgttatgttgctgttgaatgtttagattttgtggccaggaagtcaatttatttggagattgacaagagcttttttttttttttttagacaaggtcttattctgttgcccaggctggcgtgcagtggtgtgatcatagctcacagtagcttcgacctcctgggcacaaacaatcctcctgccttagcctctcaagtagctgggactacaggtgtatgccactatgaccaaataattatttaaatttttttttgtaaagacagagtctctatgccgctgaggctggtcacagactcctggcctccagcagtcctcccacctcggcctcccaaggtgctgggattacaagtgtgagccactgtgccccgctcaacttgaacattttgaagcttgtgtttaaactttgttagaacaagtctagagtcacccttaccatggggctagtgaggcccttaactaaagtttgacgcttctgaggtttctattaaatttccagctgctcaagaaggactttccactctagccggtcttatcaaatgtctcccagcccagtgcaagctttagtggttgttcagcttccagatctctggtggtgcttatttccttggtacttttggttgttgttgtttttgcccattctgctgtagtctcaccctctgtatgagagctttgtattcagccacagatctgagagaaccccatgcaggtttctgaagctctttttctgtactgctcccttatctctggcattctattgtgaagtttccaagcctctcagcctcttcaaactccattctttgtctcagtgggacttgcatgctctccataggcccccctccttgtgttgcagtctgcacaaggcacagttgtgggagggctcacctcatttgttttcacagccctgcattgcatgttgcctaatgtatgaaaacaatcattctgtatattttatatcatattctagtttaccgtgtgagagttactcagtcgttactggaggaggccacaaatacttattaaacgtgtgaagtattttagtttccatgctggttagtaggctgtgaagatgagttagtgtgcatagaggaggtagaggatgtgaaactcagggtgggtgggtgaggaggaatttgcccaagacaaagctattgttagacctaggaggagaggcctggtgctttgcatcctcgggctgtgctttcacacacaagccacatcatctcttccctggcttagctgctctgagcactgcctcctcctcagtcgtctcctcctcttcagttatgtcttccagcatttgggatgctgacttcttcagccaagccccctccaagccctccccatacccacattcagataaagtggaaagaggttttctatcccaagtgtatcagatcatttggaaagatcaagacccactagctccatcatgagccagtggatgagctttctgattgtccctgctttgactcccacttccgatttgcccaaagcccctctcaccaccatgcagcctgcaatatgagaccatgtctgtgaaaccgtgccatgaacagcaacacttaaggaaattggattatttaatcaataattggagcaataagcatctgcctcggtgtgccaggccacaagaggcacaggtaaaaggcctgtcttctcaagaagcacttattctagagactggctgcccactgtggggttcagttagcagaaaacaccctgctgccagtggtttcagggtctgcctcaggtgcagataaggcaaaggatccctttgcccaaggtcatgacttaccagggaagcccatcacttgtggctgaatgaggagggcgtataaagacccaggcattttagtctgaagtgaggcaactctgatggacgtcacttcttctgaatctcatggctaggttggctgaagctttgtcggagctgcatccaaactcagcctcttcctctgcccaatcttgctccctctttcctttcacaacagataatttctaattaacagcttgtgcccacacttcaattccacacctgcttctagggggcccaactcgtgacacagggaatggccgtgaccatgggctttggcagctacagtccagtccactttccctgcagacagggaaaggtcaggtcaggcaggggatgatgactccacagaagagtcaccctgataccacaggcttcagcttctcaacactttttacctcccttcttttttttttttttttttttttgagatagagtcttgctctgttgtccaggctggagtgcaattgcacagtcttggctcactgcagtctctgcctcctgagttcaagtgattctcatgcttcagcctcctgaatagctgagtttacaggcaccctctatgcccagctaatttttgtatttttagtagagctgaggtttcaccatgttggctaggctggtcttgaactcctggcctcaagtgatccacccacttcagcctgccaaagtgctgggattacagccatgagccgctgcacatggccaatctcccttctttatcaatgtgacagaaagttgaaatgaagatgaattactgggacatgagatcagattatgtttattgagtgtacactctgagccaggtactaagctaagtccttcacttgcattatcacgtttcattccctcaaacaacctcccagggaggtaatctcattatccccactttataaagccctttgcctctgtcttatgagagttggggcaggcctgagggcaatgagtgatgatctcagatgccctccagggtcctggcctgtcttctacagcatgaatccctgtgagcagcttcattctcattgctggctcctgcttatctcctctttcttctcctccctccccagctctcagttctgcagatctggcagcactgctcagaccctaccagcaaatccgaggcactttcaatgcccatcccccaccctcaaaaataggaagaggagaaactctcagaccacatcctgcatttgagcaaagttcccaccagtggttcaatgcaggcaaacatttatgcgacatcttccaactcatagccaacctagcaaccacaaaagctgggctcccaagaggtcactctttcacttatcagcaatggactaccagtgatcgacctgctgtgtgtgggggaaactggaagtgtacagatgagtgattcattcatttattcttatactttttcacctaacagtgacttactgcggtcttattttgtttgaagcacaggtcctaaagatgtggtgggtagcaagaaagagtcttgatcttatgttccacttagtggaagaaataagatttacagtccattatcaaacaatttcgtaacagtccagtcacatgcacacaaagtccagaagaatgtacaggagatttgtagtttgggatggatcataacatctcacacataaagggtctcaggtaaggtgagtattgaggtggctgctgcagttcgttttcttcctccctggttctgcactgggcccaggtctttctatttaggctctctgggtgcctcacagacccactgctctccccagggagcacatacctctctctgaacctgctacctcttctcccccacgccccgtcccagtggacacttggcctctttaaacctccctccagtgtcctcccttattgatggccacactgagcaagtgtggtccatgtgtcccatgctgagatatgctaaaagagcctggctcttcctcagccttgaagcacattaaagaagtccctttctgttacaccagttttaggcctgaatccggccccagaaagcaagatgggacagtgccaagcctcaggaatgcaagcatgttagggcaaacaagaaaaatccactttgctgtatttagaacagagcatttctccttcctttatttttattttcatttttccctttgatcttccctggtgttctccctctgcattctcttttttgggtcatacttatttctgcagtgaacaaggttatgacatcatccctctgtccccactcatccttccaacctttctgagacaatcccggggccaagaggagactgagaagctgggggaggtaggatcttcccaggacacctgcccagcgccaactaggtgttgagctgcctaccaacaaccacgagagggcgccccttccccatgcctctcctgcggaggctccctcgggagtccaggtttggggtgggtcagaagtgctgcaggccctggacacaggcttgtatctggaaggtgacagtgcctctgcctcatcactgactaatagaaggccaaccttcattgttatttcctccctgtggcagaactgggttctgaatttctcctcaagcaaatccccaaagcatatttttaacctaaccttgggttaataagtatagtttttcctatctttagggattcaagttctccctggggtttggaacagagctagatcctgccttcacagacccctgtaaatcaaggtgaatcgaaagtggcatttaaatctggccttatatgccaagaaatggacatcttcatgcttccaccccgctggtgatctcggttcccatgacacacctacactttcattaagtcacccttgttcccacgtctgccatagagttacggagtccaactctgagacttcactaagactggtctccttgtgtgtttcctattcttctcctcctggcaatgcccagatcctccttctaatcccttctcaaagcttgctttcaggaggaagccagccgggtccctaccagggcagtgtggcccttctattctctgcagtcctccattctttctgtaccactgtggtgtttgtgtttaattctctgctcctttatcctgcctcttacatatctctttcctgagctagatgcaaaagctgtaaatgaagattggcagacataaaaatatttttaaaattatgtaatgaaaacaatataaacataataggaagtaaaaaatgaaaaaatacaataaatatgataatggattaatttctataatacagagagaattcctaaaaagccataccaaagagatggagaatccaatagaaacggccaggcaactcagagaaggagaaaaagtattggccaataaatatatacattaaaaagttgcccaacctttagttttaacataaattaaaataagaaggcataattttaatataaaagatagactgataatacccattatttattgtttactagaatgggggtaataagcatgcctcatacgtagttggaaggagtacacgttaaagcacaatttgaaaagtagcataaaaatagtgtgtggatgtcttttatacaaaatcatctcattgcagaattatctgtgactgtgaaatttgaaaataactgaaatgtccatcaatgggggatgtagtaatttaaaattgcatataaattgatattctctattttgattatgtgaaaggatgctttgccataaattgttgagggtaggggagaaaaagagagagagagtgtatgtgtgtgtatgtgtgtgtcaagaaagaggagagagagagagagaagggagttagggatgatgtataccaaaattgttaacagtagtttctttagagaatgaataggtactttcattttctgctttatatattttaatattcttagggttttgctacaatgtaaacttgctacaattaaattttttaaatttctttttgagacagagtttcgctcttgctgtctaggctggagtgcaatgatgcgatctcggctcactgcaacctccgcctcctaggttcaagcaattctcctgcctcagcctcccaagtagctgggattacaggcatgtgccaccatgcctggctaattttttgtatttttggtagagacggggtttttccatgttggtcaagatggtctcgaactcccgaccttaggtgatccgcccacttcggcctcccaaagtgctgggattacaggcgtgagcccctgtggccagcccaattttttaaatttcaagtttgaggaaaaaaggaataatttgtttacatgtttgtctctcccactaaaaacataagtcaatagaaagctgaaatcaaattatatttggttcatatttggtttactgtataaattacatttttgcagtgactgacagagtaaacactccattaattttttaaattacttttcttttatacattttaagggtggatgctttatttagcacatacttcattccccctaatgttatatttacctgtatttatacatttgccttcccaagtagagtacaagtttcttgaggcagatcaaatagggactctataagctcttatcagttctttacaaggtgtagattttccataagtgtttgctgtatttgtcagatgctgaaggattgaaagccatttttcctccttgggctccaacccccacacccacattatcttcctcttccatggtggggtttgagtttagaacatactaatgtctcttgtgactttgaaagattaggagtctagtaaggaatgtctccaagttaggttctcagttggaataggcactggagcagatgaagaccttgcttaggagagaatccacagcttaagcctggaaggaaacttgtttaagaaaaaaatctgcaaataattgccatgaccttgaccacgaaagtcaaaatctgattgactaagctttctcttttagtcctggggacaagtttatcattttctagaattaaaatgtcaggagaaaaaagatacatctctccatccaccaacataataaggcgtaatgtcaggaaagcagagataaaacattaatgcctttctttactgtactctcagtgccaatctggtcatctgattgaagtacggagatagacaactgcaaagcaatgccagcgagagcgaatgcacaggcacactgtgaaatgctacatttaccttcttcagcagggcaggaaatacctaccaaaagatgaaaagatctcagttcaaactaacaaagaataccatgagtgctttctttttcttttttcttttttttttttagatggagtctcgctctgtcacccaggctggaccatgagtgcttttttaaacctcattttaaatctgaaagaagaatgaatacattggtatgcataagaagtttagtatgaacccatactgtgttttgttatcaacaaagaaacaagaacaaaattggcaccctttcagtaagctcagctgaggtattttcacactgaaggttctgcaggcttctggagcccttgagaactgagtaggtaggttcaggcagctgtaacaaaataccacagactcggtggcataacaacaaacgtctatttctcacagttgggaggctgggaagtttaaaatcaagctgcacacagatgaggtgtctggtgatggccctcttcctgatctgctgaaagccacctacttgctgcatattcccatggtaaacagagatcatctcttctgtgtctattcttgtaagggcactaatcccattcatgaggactctaccctcatgatctaattacccgcaatgccccttctccatagaccatcacactgggacttagggcttcaacatgtacattttgggtgacaccgaggagtcagttatgaaaaaggcactgggagataggtagggagatgtgcaaggccctgaggatctgagcctttgagtctggagtgcaagtccattctcacaggttaaggcaggatcctgaacaaacatttgttgaggtttttctttttgtgtttcacataattctttatttttattttttatttttttgagatagagtcttgctttgcccaggatggactgcactggtgtgatcgcagctcaccatagccccaacccctggggctcactcaggtgatcctcccacctcagcctcccaagcagctgggattatcaacatgtgccactactcctggccaatttttccttcgcatacttcttgtacttgcacagtggagacacagacaccaatacatcacaatacactgtgaaggaatgaaaggaaatagaatgcactgtaggcagaggtgccagctcgtctctgcttgggggacagtgggaagagctacagagaaggtgtcattgtaggtgcctggtaaacaatagctgttgtcgggtgtggtggctcacacttgtaatctcagcactttgggaggccaaggcaggaggggcgcttgagcccaggaattcaagaccagcctgggtaatgtagtgagaccctgtctctacaaatttttttttttttttttaattagcaaggtgtaaggtgcatgcctgtggttccagctactctggaggccaagctgggaagatcctttgagcccgggaggttgaggctgcagtgagccatgatggtgccactgcactccaactggggtgatacagcaagagcaagatcctgtttctaaaaaaattaagcaagccagaggtggtgtgaacacagagagaggtgggggcaagaagaaggagacagattgggatgatgaggaaggagattcagggccgagggtgataccaggaggcagagcctgagtatcacctccttcccttctccaggaccgggtcccttttaggtgagactagatgaaaagggctcttcagcagctgacttcacagcaactaatttctgacaggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgagcatggggttgataattcagcaggaaatttggtgaggaaggaagaggtaacaggtctgtagaagaagtaatcttcctcctttcctgggacttcagtctttccgttgaccttagtgtcaaaaaatttcaagccaatgcaactgttgtaggggaaccacctgatctttcctgaatggacaaaaatgcagcagtagccagaaccctttgcactggcaggatgttctcagtttgtgcagaggtccttcttgtccacattagaactggagctaagacaggaaagaggccaagctttcttagtctcttggtgtatgagcgttgtattgcgagtcacatctttcttgggctctgctgtggttatattttacaacttttggagagccccacatttctcatctgcagaatggtttattgaatttaatgttttttaaactctccctttcaactctaaagttctgatccaaaactctggcttttgtggtggctgggaattgggatgagagtggggatgaggctaaataaacaaggctatgagtgaacgggggacgtttaccaggaggggaggggagggaatatgtctgctggaggaaagaaatcatttatttgtgtccatacctctttcaccttgtcttaccctctcaagccatgaagcccccacttggcaagagccttttgggttccctgttgaacttagctgagccctggactgacccttgacagggtagagcccgtagggaggccacactttggagaagggcctggaggctgacctgacagtggatgtgccacagagaatttctctgaccatttacttagtgagtgtgtggagaaccagggcctaacctccctgcctaaaaaaacatgtgagtcatcaagagagaacagtagagccctgttttccagccctaagctctgcaggggaggaatcagctccagcagctgtgtcattgaaagttttctctcctttttggctgcccctttcttcacttttggacccgtaaaggtttcagagtgaacaatatccccaggctggggggattgcagttccaggagtcttgtccattgggcaaagtttctaggatccaggggtctgctctttttttcctttaggaggatgtgttaagtatagaataatctcaccagtcttcctagggtagatgtcctatggagaagagactgggcataatttcaaacatataagtttaaagcactaccagggccagctcacactgcttatcttgttctaagagttaattgtttatacatagtgggaccatctcaatttgcctgagatagttctggttcaagctatcgtcctagggaaattattaataatgttcctttttactctttgaagggtctcattggacaataaactatatggtcaccctacctatattcaactccagactggactatgagctccttgagtgcagggaaggcattaactgcattataatttccccagtgtcctgagcaatgcttagcacagagcatatgattcaataaaactttgttggataaatgaatgaaaaaataaattcccagcttggaacatgtttctgcctaggaatgtagagacacaaggcaccccagggctggggacctcaaggtcctataaagaaaccacaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcacaccactgcactccagcctgggcgacagagcgagactccgtctcaaaaaaaaaaaaaaaaaaaaaaaagaaaccacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggtaagtagtcaataagtcactaccgcctggatctcctggcttgggtgctttcatttttgatgtacagtttctttttctgctacatgctttttctcttgattactctctccggttctgccactgacatatttatgacactgagtttttattctatctttttgtgtatcccttgttctagttctttttgagccactctctctctcacccctcccccatagctggcctcaatatgtgtgtgtgaatacaaacatacacaatgtttgtattatctgtttctctactgatctgtgtcatccatccatacatacatactgaatcttagtgctccatgggtgtttcatatgttggtggtatctctgtctctcaatgtatttttttttaaatttttttgagacagggtctcactgtaaggtccaggctgtagtgcagtggtgtgaccatggctcactgcagccttgacctcccaggctcaaacaatcctccaacttcagcctccttagtagctgagactacaggcatgaaccactacacctggctaatttttaaattttttgtagagatggggttttgctatgttgccagagctggtcttgaactcctgggctcaagaagtcctcctgcctcagcctcccaaagtgctgggataacaggtgtgagccactgtgcccagtctcagcgtatttcttaactggggtctgggtactcaagagccagcactaaaggcccaggctgaatgaccctcagaggctctggcagaatgagcaaatgatgcaatggctgtcttggggagaaaattgtgactttctggactctaaggcaacagccctagagtctcactggctctcttcactctactccaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagtgagtaagatgggggtggaagcatcctgcatggattttagaggagggaagctggtcttaagctgacactaagacatactatctcattcattcattcattcctatatatttctctgggtgtatttctgatcctaactgttctcaccagtgcttcatcccttcactgaacttcactttagttcaaacagccaggccctaattgtccattttctctacacttaagaactctgttctttagacaaaggcttccctggcagccagaaaataaataatcatcttattcttctacttcaggaatcccaaactgaaaattctcttgtccattggagggtacctgtttggttccaaagggtaagactacatctttattttttgttcatttccccatgtaatttttgatcatcatcatttttcctccttctaagaagagatattaaactaggctttaagaggttttcccttggccaggtggcaaaactgatctgagatttgtcataagcagaggaacagcattaggtttcctggggtctttgaaggaattcttctggagcttaatacaagcccagacactcaaggcttgagagaaagtgggccatgaacaatattcagaaaattctgaattatttacatgaatgtttttcactttatggattatagaattagttttaattggaaagtgcaatttttttaaaaatcacttgagggtttgactttgtgccccggggtgggttggatgggttgcttccattcagaagccccaccatggcccatagcagtcagtggagtacaatgtctgggatcatggctgtgcagccagatggcctcagcaccatcagagcagcagaggaaacaatcagtcctgctttgcttaaaatcaaaatagctattgatacaaagcacacattcgaaataatattttctattcccatggaaatgatatcccatttacatcaagagctaaatgaaaatacataaggataaatatcacattttttcaatcttcagctacagtttatctaattttgaatttcttctgctttattatttaaagtgctaacatcttaaaaagtccagagatcttaaatttggctgagagagtcttggagtttttatagaaatctgatagtacaacttgtgcaacctgtcagaagtcagttacagccagagtaggcagagagaagaagtagtgttagaagacctatgtagatttctgcacacagaaagaaggaagaaagatcaggctacctaacttttttggttctgtgttaactcctccgtgaacacccttcaatatgaatgggcttccatggcacccatccttctaattatcaaattttctccccttcctaatacttgcttaggtgttgatgcaaataaaaatgtcttcatttattcattcattcttgcattcattcattcattcattcattcagtaaattcattcagtaagtaattgtttaccagtttagtggttgaaagtagaactttggagatagacgtgtttggtttggatttccctttagatgcatgcaagctatgtgacttttgtcaagttctttatgtctgtatgccgcagttttctttaactatacaataagaataataacagaatttacctcagggtggtgttgtaaaggcaggcaacgcaagcaaactgtttagcatagtgcccctgtgcaataagggctcaatggttgcagtaatcattgttatatgattattgttgttattattaggtaaatgccaggctttgtgccaggtgctgtgcagaataattatatatgtgtaatatacaaacttgcttctaaggaacaaattagtaaatttctattgaatgggcagctctcctaaaattggaggcatctgcccagaggctcaggtgcaatggctttctaatcattgtaagcactttcaaatgcaagagaaaagctagaaaactatttccaccgtagttttctgatatcaggccagtttcttgctatctcttcaacttcaaagatgagatacatgcaggaatcaaaatctcaatttaatattgagtaaaacaaaattaattcaaggctctaagaaagcctgggtgtgggaggtattgtaagaggtgaaaagtgacacaacttaaaggttatgtcctcaggaaaataccagtatctcatctacagctttgggtttaaaatgctattggtgcccttggtgtgggcatctgagaatcaacttcatggcttcagaattctagttcagatgaagcccttgaggagctgctgatttcaagtcctgttttcatcagaaatcccgggggtggggagatctgcgttgcctatttgtggccgggatgcttgtttggggaccatgaagtcactggagtccagttctttttcctggaacttccctaaatgttatccccttgaggcacatgaagcaggattagtaccctcagtcccaatttagaggtggccagactggaacccagagagcaggttaatgacaaagtggccatcaatcagaaaggactctaaccttggacttgaatctagttctcctgaccctaagcccaccacattgcaaactgcttttccaagggtgtaaagtgttaaagaaaaccaaagctggcatccaggagggaggtggggggggtcagcaccccgcccggccagccgccccgtccgggaggtgaggggcgcctctgcccggccgcccctactgggaagtgaggagcccctctgcccggccaccaccccgtctgggaggtgtacccaatagctcattgagaacgggccatgatgacaatggcggttttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatcggtgaccttgcccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaaaaaaaaaaaaagaaagaaaaccaaagctggacagtatttaaagcagtaaaacagattttattcaggaaatattgaaacggggaaaaagacctcagtatggtactgggttctattccaaaggcagcaaaggcaagtgaggaaatatagccaaagagcacgctaggggcaatcagtggatggaaaatcataaagaggaaacactggggctagagggatggattcttgctaaactgattcaacaggattcctgccaaaggatgccagagcgatgagataccacctgggggatggcagggggtgagtaatcaggtaccaggtctgggggtttctggctaaactgacctagcaggactttttctggaatcggacactgcaaagacagacacagaagcccaagattgaggtccagttgagaagagggctcagagaagcctacctaagtttggtcaaggcaagagtcttagccaaaggcagctccgttacccttaggaaggtctgcagagaatctagtcttcctttacctggctggatcaatgttccggcccaacaatcctttttctctcgtctgttccaaaaggggaaagcattagaatagacaaattgtaagtgaatattggggaagagaagactgctcaggatttctgtgaaaaatgtgttacactacaagtgttacttgttctttccaaaaagacactcgtattgcttctttccaggttccaccctatggtggattcttctacatcacgcttggaattcattaactccataatcctgtttctgaggaaccataactttgatggactggatgtaagctggatctacccagatcagaaagaaaacactcatttcactgtgctgattcatgtaagtcatgaatcaagtaattcatgtgagtcagatgccacggtgtactcagtactctgatatccagaatccatggccacattgggagacaaaaaggaggagattgagtctaacagccccagcctttctgaagctcccactaatgagagaaaagccctgattcctattttaaggcagtaacaacatgaaacagtggagcccccttgcacatttattttgatgtccttctttttgatgaagaacatcaaaataaagcaacatccatatgaaagagggtgtagccataggatttcctgagtactgaggtggcctcacagaagatctatcagatagatctgaaaatctatcaggtagaaaccaagatagttattcctgggtagagtgaggctggggttctcctgcctaatgtggagacttcctgagcagatacaggcacaaggcatccccatgtggggtggggaggaaagggttgatcctttccatctaatgtggttctagaaacctcatagattccaggcaagaagcttagcactgtactctgggaaggggaatattgcacctcgtttctttgtttttcctaggagttagcagaagcctttcagaaggacttcacaaaatccaccaaggaaaggcttctcttgactgcgggcgtatctgcagggaggcaaatgattgataacagctatcaagttgagaaactggcaaagtgagtacatcagagcaactttccatccctctgcttccaatttggtccatgcaaatgatgcatcagcatgtttgacggatgaggggaggaggaagagagggaaggtcattgtcctaaccctgcatcattcagccaggaacaacttctttacagagactttcaatccttctagcagcatcattcaaagccaaaacaattacttacaattgtttctaccactgctcgtcacaaaatctctcccattgcttttggcactttagagatctggatttcatcaacctcctgtcctttgacttccatgggtcttgggaaaagccccttatcactggccacaacagccctctgagcaaggggtggcaggacagagggccaagctcctactacaatgtggtgagtaggccaggggaaccgcaggggtactggctgtgggggtggggctggggagagtccagcatgtctagagttacttctgtcttgaactgaggaagagctatgagcccaagagggaattgggtagccccaggagcaagtgagtgcaggagaagtgctttgaccaggcaccaacaaaatgtcacctagaaaatatcagaagtgctgatagctgaagtgccctaagctctgtctctggctcagagtgtcccccatcccagtcttctctggattctccatctttcatacatttcttggcatctacacaggagaacagaacttgtaccttcctgtgtccatctatattccctatttaattctatctttaaaaaaaccccatgaggtcagctgggtaggaaatgttactcccacttcacagatgatgaaacagaagcttggcagattccattgactcttcaaggtcgtgtgttgtgaacttcctggtgatgggaaatgaaaagtaaaaaaaaaaaaataatgttgttgatgttgttctggaacataacttatccacccaatgggttctccttgcccattgatttatcaagataggagaattgcaatagagaaagagttaaagtcatgcagaatcagctgtatgggagactggaattttattattactcaaatcagtttccctggaaattcagggatcagggtttttaaggataattttgtggatgggggacagaaagtggcgagtgctgattggtcaggttgaagatgaaatcataagggttcaaagtgggtttttctcgctgtcttttgctcttgtttgggatcacagaactggttgagccagattcctgggtctgggtagtgtcagctggtgcatcagaatgcaagatctgcaaaatatctcaagcactgatcttaggttttgcaacagtgatgctattcccagctgcaatttggggaggcttagaatcttgcagcctttggccgcatgactcctaaaccataacttctaatctcatggctaatttgttagttctacaaaagcagactggtctctaggcaagaagagagtttgtttctaaaaagggctgttaatcatctttgtttcaaagctaacctagagactaaattcctcccaaattgagttggcttacacccaggaatgaacaaggacagcttggaggttagaagcaagatggagtcagttaggtcagatctctttcactgtcataattttctcagttacaatctttgcaaaggctgtttcatatatatggatgtatattcctaaaattttgggagaaaaaatatctgtgttgcatgtttccaggccttcatattcaaagtcacaaaatggatcggtccagagctagatatgatttctggttggggttttctaggccttcatgtggctaagtcacatcagcctccttcactccttcctctctatcagttatctttaaggataaggagacatatctttgtcttctctaaccctttattttgttctgagagcaggaaagccaaaatcagcctcttacctcccaatctgtctataaaccaaaaataaaattctaagccccccagacatctgaacaaatccttcctcttggccaagggcattcaaagttaatctgaaaagttaattcaggtcatgatgggaagttgggtgtcagacatgcctcacagctgaccagcattaacatcaatacagagaccttaagactgatagaagagaatttctaagtctgatgagaaacatttacaatctagtctttctgaagcctgctacctggaggctttatctgcatgataaaaccttggtctctacaccacttatcataacccagacattcctttctattgactccaggcctttacataataactctttcaaccaattgccaatcaaaatatctttgaattcacttatgacctggaagctgcagcttctagttgtcctgcgtttctggagtgaaccaatgtacatcttacatgtactgactgatgtcttatgtttccctgaaatgtatgaaatcaagctgtaacctgaccaccttgggcacatgtcctcaggatctcctgagagctgtgtcatgggccattcgtcactcatatttggctcagaataaatctcttcaaatattttacagagtttgactctttacgttgacatgtcccattgggtgcaaggtcattgtgaggcctcatggactaggaatctgacagccacctttgtcagtattcacaaagagccattgtgtagacaagttccacagggattttgagttgactcaaaaggggaaggaagatggtgacaaccttgatttcatgttttctaggttccttgactgatttcttttgtgatccactgtctagttcctttcagaaattagaaaaagttgcataagcctcttgctgctaaagagcatatgtgcattacaacaagcactctggtccggggggtctggtctgttcacactcggatgtagaaaagaaaccaggcagtcacctctgtgaagtttgggatagaggctaaaaaaggtctgacacctttctttccccacactctgagcctccatctctcttcccattctaggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgaggtacctggaaaccccctgtaccctcagctccctgccatgtctgggtagatgttccatcttcaatttgacagcagagtaaagcatcctgagtgttgcgaaggggaaagggcagagtactactgaacatgtgaggggatctcctaactctgggttgggagagggtcagggaatgcttcctggaggaagtgaaataagctggactctgaagaggagatggagctagccaggaatggggataggcagaggagagtgcgagaaattgaaaaaggaagactaccccaagttcttgatttgagcagctaagtggatggcaatgccatttacagagatagggaagactggagggagaacagagtggacattggtcctgctcatgagatcagttttggacgttctgagtgtgaggagcccgtgggacatacagataacaggtgagtcattgaatatatgggtttggatcacagcaggccagtctgcactagagaggtagattcaaaactatcagcataaagctggtacctgaagccaaaccatacagtgagaagtgaatgaggccccagacacacccaaaaacctcctacacctgagggacatgcagaggaaggggaacatattaaggtaactgacaaggaactacaagagggataggaggaacccacccagatctgtgccaaagaccttagagaagtaggtgtttcaaaaaggagggagtggtcaaatgtgtcaaattctgtgcagttgtcagatagatcatagggataacaaaattgttctgctaattataccatcattcctctctgccctccaatctgggaaaatttatttaaaaagcataggggaagatataaatctaacaataggtcaaccaacagaaactctttggacactcccatatcccaaacactgggtactgtgaaagctagaaataagtaattatccatccttgtctctaaaggggttattgtcaaggtggaaagaatgtgaaatacagacatagctagttaaacaagagttcaaaaacaagataactataacatttaataaaatcagagaggtattgtaaaacaatatgggattcaatgaccaatgaatggtgtagagtgacatgagatcagagatgggtgactggggaaggctccatggaagaggagaagtttatgctgggccttgaaggattagtagaaatttgatcaggtagagaaaaaaaaatatcattctatatcctggtctatctttggagtcccagcctgacctctcattgtgagtgtgaacatgccatcggcccatgctgaatgacttggcacccaccaaggtacccattcagtgtaatgctcaatttttcccttcatcttacacataggaatgattggcacatcatcaattcaattggcaacaagaatgggacatgggtcattgtgagagtcctcattgaatctcagggtgcctgatacataggaagtgggagagaggctgacccatccttgggtagttctaggttgatagcaataacactcttaatataagggagaagagaggtcattgctcagaatctcctggtagggttataatatcaaccactagatatgcacttcccatctcatggaaagtttgatttgattgttcagttcataatgactctaggtcattataactttgacaggttgatatttgcttaaatattcaactttcattttctgccctcattgtagtaagcacgaatgtagttcatccaaaaagagtaatcctaaatggattttctatgtgatgttgaaatgcattgtttaattgaagatttatcttttttagagctcttccttatgctaacagaaagaatatagctaatgatagaaggggagccccaggacagggcatattggatatgggacgggacagaggaggagtaataagatttaagtggagatgctacaagatgaggaatagtggtgatggtcatgataatacttcactttagaagtagagcactttactgttttcaaaaaaattttttaatgtgtattagttcatttgatcctaacaacaacactgtaaggtagatatgttgaaagcattattataattatttccattttgcaaatgaagaaattggaagatttattggtcggtgctggggtctgatctggaactcaagtattttctgatttctagctgctgtgtctcctcctgatgagactttagcacagacacttcctagaggttcaccttggaacacccacttcatatgatatatgtggtcatttctctcattgtctgatccttgggataaaggttctgatattttccccaagtccctagtggctcacctgccctgtctaccccaaccaagtttcaagaataacccattactgaccctctcgtttccctttcccctgccagatctgccagttcctgaaaggagccaagatcacgcggctccaggatcaacaggttccctacgcagtcaaggggaaccagtgggtgggctatgatgatgtgaagagtatggagaccaaggtaggtgggccacaggcagatactcctttaggtggggaatggtgatatgtagtaaaatgcctgaatactctatgttcaaagatagaagcttctgaggccccagactctaggatgggatccagcagcctttatagctcaagtctagtagtgactctatgtcacacccgcgagcagctgtggtacaggtagaagagttggaaaggacgcaaaaaagaattgagaacaagtaagtttattctgataagtgaggagtggagagaagagtaaggcaaggagaagggagagggaataaaggagacgttggtgcctgtatagataatctactttgttaattatctcgggacaaactgttcagtccttctcatggattacctagctaggaggctccagattcctgagcctaccagttcttagaccttggtaagacatttgtgttcctttcatggttagaacaaaaaggaggcttgagtgtaattgacaatcctggccacttgtcttgttaagggcttcctagtttcttcccttattatggagagttttctcagcctccaagaatgccggaccttgagtgtggtgactcaagtcagaatgagatgtagctaatgctgatttggtggctctctctccctgagcaatcttacccctcaggaagtctctaactccagaaaaccagttagtctactgctgtattttaagcttagtccctcatctgaacctgatatggtcctgggcatttaggggccacccttcgaatctctgtgtatccttctgtgtctcccataggttcagttcttaaagaatttaaacctgggaggagccatgatctggtctattgacatggatgacttcactggcaaatcctgcaaccagggcccttaccctcttgtccaagcagtcaagagaagccttggctccctgtgaaggtaacagtccaggctggagctgggagtgggcagacagctgggcagaacagggcacaggagactgggggagatcatcttcacatatttggactaatcctttctcatgctcctttggctcttctgccatgttttcttagcaattaggctggttctgcccttttcataggcttcccatagacttttaaagtaataataataatattgataaattttggctaccatttattgagcatagtatgagctaaagactttcattacatatatattagggataaatattgacaccaccacaattcttggttacaaaatcatcagcctgtcttaattttctaaatcacaataaatctgactctatgtcctcaattcactggactgatgataatttccatctcactcattacctgaggctcttttcccccacccacagttgatcttacttagtctagacatttgggagctcccatggtcattattgctacgcctttacccaagcctccctattaccttgaaggtcggtggctttgctgctgctccatccctgggcccccagttccctaggtgcgttgtatatcctcctgtgcagatgaaggctgttgctgaccaaacagttatgctgtgatacattggttctagggcagagggtggagaagcagggcgctggggctcactgcagacagacaactaaaagactggctctgctatcctggcaaagggcctagaaccatttgaaaactcctgattagataattgggtagcagccttccaactctgagcatccattgtttagtaacttgacttaggcctcagtttactgagttgggctttgaaatatttttccttttgtttccaggattaacttacagagaagcaggcaagatgaccttgctgcctggggcctgctctctcccaggaattctcatgtgggattccccttgccaggctggcctttggatctctcttccaagcctttcctgacttcctcttagatcatagattggacctggttttgttttcctgcagctgttgacttgttgccctgaagtacaataaaaaaaattcattttgctccagtaagtatggcctcatttattcagtccttgaccctgtgatatcaggttgttctgtccctgctatttgtgggatccagagctagggtgaaaacgaagttttgcatatcatgtttaaatattaaaaacagctaacatgctgttaaaatatgacttatgctccaacattaacacatacaactttgcaaccacctagaaggtcagaacctgaaaatttaaaattctcagactccttagaataccacaccagaattcccatctttgcctctgtctctcacagtaggagcctcatgggcatacttgtggacattgtaggctttgtatccaagcttcatctgcactctaccctctaccctcaacctccaacacacaaacccacccacacacacatacacctgcctctgggctatgcatgtgcacaccggcgttgtggtccactctcagtaaagatgggcccagggaaaagtcatgtgcaggctctgagagagcgcacaggctcttctggctatttgggtagaaatgctggatgtctggatcatgatttagaagaggaggtatgtgagctttaggtgaatgtgctcctagcctggcagtctccttaccttgtggggaggggtgcaactggaagagggcccaagtgggaccctccaaaggagggtcagcaaactatggcccatggatcaaagctagcccactgcctgtttttgtaaataaaattttattggaagacagccacactcagttttttttacatattgtctgtggctactttctcccaacaatggcagagttgagaagtatgacagagatggtatggcctgcaaagcctaaactatttactctctggccctttacagaaaagtttgccaaccccttttctaaagcacggtgctcacagcaccaggtctaagactgattccggtgtcagactccttaattttaggatgaactgttttcccccattttcccaatttcttccaatcttttccgtctagaaaagccacttttatcctgacctttgaacaacagtttcatgcacatatttaattctcatggcttgtgaagttagtgataataaacccaattttcagatgagctaactggggcatcattgtaagggtacatgtctgataagtggtggcaactagactgaatccaagaaggcggctgcaccagaatgtccgtggaggagggcattagaggtggctacacgatcaaagcagcataaggtgggaatactaggagacttttttcaaaactgctttgaatatcctattatgatggaaaaccccagacgtacataccaaagaatgggaatggcaagcactgacagatactaagggaagttagtccccaaggtccccttgaatgctgctccagtgctcagatcttcttactacaaggtagaaattgcttgggcacctctctggctttctaactctggctttctaactttgcttcctatggtaattgaattctcaagaagcagaagatcagagtaattaagaacatagtctggagccagatctcctgggttcacacacagtggctttgttaccaacctagtggctatgtgaccttgggcatgttatttatcttttatgtgcccccagctttctcatttttaaggtggggataataacaatatctacctctcagggatatgataatggttaggtaagttaatatttgtaaggcatttgggcaaatgcccgacacatcacaaatactatttgtgtttgttattatttccattaaaaggaaaacattagataaaacaaatccaacagagtttatttgagcaaagaatgattcaatgaattcggcaacactcagaaccagaagaggttcagagagctgtcctctgcaatatggagaatgagtatttatagacagaagagaaagtagagaaatagtctaattggtcacagccaggagtttgccttatttaaacatggtctgatcagttggctgcctctgattggctgagatctggttactgttacaaaaaaatatacttctaagttaggtttcagtttatgtacatactacattaggttctagatcattaggagggactcaaactacagagataacctcaggccaaagttaatttaacacttccattatccagctgctgtaacgggcacaagagagagtatgggcagctgcccaacacattaaccttggccttgcatggagcctaagagcccattaaaggtctatgtcttgggctctaagccgtgaactcatggagccctctctcatgcttactgtgaggatagaaccatttgttttgcaaacatccaggagaagattaaggaaatcaaggccccttgtttggctggggttggggatggattctggtcatcctttcctttcctctcctctcctctcctctccgctactttcctttcctctcccctacacccctacccactacaacccctttgaggagatctttgtaggctaagagtcttatgccaaggaggaaccatatcttagacttgctcaggggcagtatgggtgagagtcaggaggtcgtaagaacccaggccccagttggtctccgcttggattacagctctgctacttctcggtgtgatctttggcagtttgcttagtctcctgtccctcagttttcctaatacgtagaacagatgacagtaatagcatcttcctgaagggatagttttgaataaacgaattaatacatatgaagcgtttagcacatcgtaagtgctgaatgaatgttcgctattattgtgttcaacactgctccagttctagttagtcaatgcctccagtttttgacattcttctagtgttcagacagaagctaaacagtcaaaagcctgggaaggatggggacagattttaggtaataaatagctttggaaatgccatcagctctgcacaaccatacacatgtactaaagttggtaggacccatttctgttttctttgtgaatctaatttgcctttaaacggatccggcctcaaagatcccaatggtctgagtagcatctcccagaaaaatcttgaaaatgtacctggcagatctcttaagaaggaggtatcttggcatatactgggagtggagccagcagcaagactctctcctagatgggatttcatttaagttaggctatgtcgatgcctcggggctaatgtcaataccaaaggtttttttaaaaaggcctgccttggaggacagcagatcacatctttggtactttcgttgtcttctggggcagagggaccctcagaaatggtctagaaacctatgatgtggcatcatggtgggcttcctgtaggtggcatccctttatgtatgggtagtaagactggggaaggagtggaaggaggtgggtcctaaaatattgtgattttcaaagccttgatccctgggcatttttgcagctgtcttttctctgatatacattgttcccgggatctgtcccagggcttgctgcctctcctttctgagtcaaagcataattagaaatgtctgtcccaggtgaattttctctgtcctctgtaaaccagacaacatttgaataaacagaaacaaccttggaaaatgatgctttctcatgccaaacttgatagaactcacaaacttcttgtagccactacccaaatctattgctataatagaatcaaggtattagggcctgggcagggataaacccacccaggatggtttatccaggaatgcggtcaaatggttatttgatgtcctttgtccatactcctctgctagcatccatctggtctctttggacacatgggacctactctgaccccaaatgactttggactctaggtcagcctcatacgtgtgccaaatatgccattttcctcaaagaactttcagtcaacagccttttaaagctgccttcccatgtgtccctgggttggttacccaagatggaaaacacagataagattcagagagctaaggggagccgtatgccacccctatccctttattcctgatctcccatcatgcctgctgaagggggtcaggtgcaggatgagagggcctgcatgctccctataaaagctgttgagtaccccactcagacctggaacttgcatttaggacttcccagaaaaatgggcaagctgctgattcttgctgatgagtctttcccaggcaggctgagtttagctttcagagcagctgcctgttctcctcagttcacttgctgtctcctcccctatcctatgttccaaaggcctgcactctgtccttcctccgtctcttgcagccttcttgagttcataacatggtggggaagtaaggaagagttcactgagcaccttagggcttcatactggagggaaagtggataactctggcagaccaggacaaggccatttccaccacgtgaaataatagaagacttaggccagcccccaccccaacccctttccagtgttctgtgattcccgctcagtgccagccacagagcaggagcccaagacactcacttaatcaaagattaaccaactaccaggagcaattagtagaaaaatgaataagacagatgtttctctgaatgtagaactctgggagcaggtgcataggagggggtttgggagagaggaagaaaaggcctcaaagagttaatgcagctcccccatggctaacttgtttcccagagagagtgaccaaactgtagaaagaagcccaataagggtgatcactgggatggcacaacagcacatccagggtgtgtttgggtggcttggaaaaggatacaatttaaaaacttcatctgagttgaaaagcagagtgtagttgttcctggaaaagatgagttgtagctctagggtgaagagactgctatgggaaggggccctctgcctgaaatctccctttcttcaccttctatgcctcctgtgcccctccccaccaatctggcttatctttagggtccattcattcaacacatattgatagagagctgactgtgtgctgggtagtggggactcagccgtgtcagcacagtctttgccctcacagagctcacagtctgatgggcagaccaataaacaatcatctttcagtgtggtaagggctgtgatggggataagcacagatgtcaaaggggcctagagggacatcagggagttccagtcccaaggtcacctctcttgggaagtcttccctgacctctgtgtctcaattttatcacttgtcatatggcattgcacctatgtgcttacaggtgtgactttccaccaggctgtgagctccttgaggggagggaccctgcctatgtagttttttgatctctaccacccagtaattaatataggtttattgaaagaataacaacacatcctcctggctcctgagtcacacaccatcacctgagcttccgggtagccaagtgaatgcctacattagccacctgctccaaatatgtcatacagtagcctatgttgggaaagggtttatagagcagagggggcgtcaagccccatctccctttccccatttactggccatggctgccataggcttgccccttcccagccagagacaggatgaccctggcaccctctgaccaagatctttttgtctttaggtctggccctcctgctgcagctgggtaagtatcccatgagagggttccccaaaagataccaacagcagaatgtttagcctttgaatgctgtccacagtcactctcatgccgtgcttcattggtagagccttcagcatccttctccccaggagaggcaggttgctgtcatttttctggattcttttctccaagaaattcaactccccagcatcctattctgtgtgtcacaggaggtgccatccacaaaggattctctgtgaatagtatcccctgaagtttgccatgttgctgtacagccccacaacaacctatcaactagctgccaatttaacctaaagtttaacctaaaattgcaccagctaaatgcttagcatatttattgggtaactactgtgtgcaaggtgcttttcatttattattttatatacccacacattaaatgcaatgaagtgggcatattaaaaccatgttaaggttgaggcaactgagtcatagggaggttaaaagctttccctagcccacagaacccaggaaggccagatcaccttatcagctaagttgatgcttttgtcccatcaggaatccaatgggtaggttttatagtcgagctcacaggaccatggtataaaggacttaggtgtgagtcctggctctgccaccttacgagttggatgatctcggtcaagttgcttcatctctctgaataccacttaaaggtcaaatgatattaacagcttctgccttgtggggttataagaattaaagaagcaatgcgtgtaaagtacctggcatttagcaggcactcagtaaatggtagatgcttccactgccggtgttccttgctctctcctagactcagacttccagctttctggccttgtgtatcccggaagctccagccaatctactttctgtgctgaggggttgatatctggctccctcatcctccccaggatgccctgtcttttcttccctgaagttcccttctgcaccagggtccatcagcccactggcagagatgggagcaagaacctactcaatgagttatttatagcgtgccctggaggactcatggcacaagggccccttgatcctacagagagctctgttcccaacacaaaggccttgtgtggaatgtgagggtggagggaccgactggcaaatgacagctcgtttcaagtggaatttctttacactagtatctttttatctccagcaacacagaactgaaaacctcgctgtctattggtggctggaactttggatcccagggataagacctagcattcaggattgaatcatttccagattaatcagtctcttccaagctccaaggactgtaagtttctctaaagtgagtgaaccccgggcctcagaccccagtgtagacatcccagaactcttctctgaccaggtctccctgaagtctgctcttccttcatcatagctcttaccacactatttttttaaattggacatttcatgattttttgttatattatttttaacttagttttttaattgacatacaataactgtacatatttatgggatacatagtgatgtttcaatatgtataatgtagagtgatcagatcagggtaattagcatattcatcatctcaaacatttgtcatttttttgtgttgacaacatttaatatcctctttttagccctttgaaactatacattattgttaactatatagtcatcctataccacactgtattttaagttccatttacttatctataccttcctctatatgagctcctccagggcagaaactattttattcaccactctatcccagcaatgttaataaatgacagaataactgaatgacagtaaatgacaatagatgacagaataactgaatgtatgtccaggcaaatagtaaggcggataagtggcaagacagagtattcaggagcttaggctactgtgatttaggctacaatgacttattgactccagattctctgatgtggcggccactgctgagaaccgccagaccttcatgcagtcagccatacagtttctgaggaagtacaacttcgatgggctggacattgattgggagtatccaggcaatcgtggcagcccagctgacacccagcagctcttcaccatcctgttgaaggtgtctcaccctcactgtgtccaaagaatacatgatctggcccacagcgggctgggagttctggagaggggttctgagagaggctgaatatatgctggccaggggtgtggatctcaccctttctggctcacagcctcatctctttagtgtaagagcagatctctcttttggggaaaactccgactggcagtgagaagtatatctttgagcaccaatgttagcttcgatgctcttatttccccttcttccattttttctgatgattagatgcaatcacatatacagtttgcagtgctggaggccatttttgtctctttaatacaatctccctccttttaaaataaaattctactctggacattatttgtttattttaaaatttaactttcagaggatgaccgaatttccctcatttccaagttttcggaagacagcttactgttatccccagataccaacaacagcttttggatcaaaggactctaaaccgagcacgttgcagctttcttcataagagctgtgacctcgtcacatgcccacttgtccctctagcctgtgttcagtgtcttctgtttcacaggaaatgtatgaggcttttgagcaagagtctacccgcagcaaaaagcccagattgttgatgtctgctgctgtgtcagctggcaaaggtaccattgagactgcctgccagatccctgagatgtcgaggtaagcaaacccaggagctcatattcagagctaagtgacccttagaccttccccgggcattgtcaaatgcccagataccagtgaccaatgctcaggtacccaggatagagaggactctatctcagaggaatgaaatgacctcaattcctgaggaagaggcagagggagacagtatgaatgctggccttgtttctaagtctatctccaaggttctctagggcaaacggccatttggagaaggttaattgagtctcaagcttctacaagtcctgaaggtctgagtgtaaccagatagtgatcatggaatgggtgccttttatattccaggtgctcttgagatgaaggtgagggagaatggaataaagaataacaatgcataagggaaactttattgcatagtggcaaacagcagatttggctgtttgtcaaatctgcaatcagccgatttgggactaggagtgttaggggtagtgggttagaaagaatgatttcccttgggtcatttatttcctcttgctctctctcccagctacctaaggtacatggacctcatcagtctgatgacctatgacctaaggggctcctgggagggcttcataggcgaggacacccccacttgcaggacctaatgaccagggagactacaaatacttttatatggtgagtgaggaagccagtcctaacagacatcttcaaagcctgtcactggatcccctgccccagactgcaaaggagaccaagaaacttgatggacagctcatgttctctacctccctgtccctgtgactgattgtatccattcatctttcacaaaaaaggaagcagaatagtggcttgggataatcccaaacattggggaattttaaaaaatatattttccatttatgctaggagcacatctcatgatccatcttcttcccactcttccttccctcccttccaccctctttcttcctaatttatgtggtttaggcagctgtaatagttagtctgcctaatgattagtaggtgagtaaatgggctagatgtcatttcagtggagatttcaaccagggatttaaaaattgacatgggaaaatctcccagtcgatgctccatgcacgaacaattctcagcattgtagtaagcccatttggaagacaagtggatgcatggctgaacaccagtcatgccccagatgaactccagtatgaggaaaaagaggatctctggctaacactgggccctgctactaaagcaatgaacctctcttaacacccattctagaaggggcagcactcctttcctttcaatgagattggactgtggaaggggtttgactggatgctgtacctggagatactagggaattaggcagaaaacctggctgttccaaggcctctgggtacatactcagctgctttctcatgatatcttcctcatcttgcctccaggattaggcaatgaactactggaagagccaaggtgcctctgctgagaagctgatggtgggctttggggcttatgctcacaccttcactctcagtaatcctgccaatcatggcctggatgctccc

SEQ ID NO: 251 - DNA, 45672 bp, Homo sapiens
cagggacctcatggagctgcctgcatcctcaggggtatgcttccttctggtctcttcctttgtcctgggtcacttacctgttgttgggacgggataaggaatgggtcacctccagttacctgaggtattaatatttatttacacccctgtcctatctccccagtttcctcatacttctgtgagtctctgtgcatagcattgtgtcctacacataatatatttgcggctggtgattatggatcttttgttgattctcctggctccatgatatttcactaaaatttaatggaagaagtattactttaattacaccttgaatatttggtaaaggactggcatagcaaagacatgatagcagagaggtgtaagtgagaagtaccaaggacctccagttctctacaaaagtaggcacgaaaagctttatgaaattcgtattcaaggctgccaatattttttctttttctttttcttttcttttctttctttttttttttgagatggagtctcgctgtgttgcccaggctgtagtgcagtggcatgatcttggctcactgcaacctctgcctcccgggttcaagcaattcttgtgcctccgcctcctgaatagctgggattacatgcatgtgccaccatgcctggctaattttttgtattttttttttttaagtggagatggggtttcactatgttggccaggctggtctcaaactcctgccctcaagtgatctgcccaccttggcctcccaaagtgttggtattataggcataagccactgcgcccagccctcaatgttgtttctgtctagcagacctacagggaaattcagattcttccctcagcagaggcaaatgactgtaagagatgtccctcagggatgtacagaaataccgtatctcactgattctaagaagcacacttttccgcattttaatacttctgaaatcatgatgtgtcttataattcatggcagcttgtaattcattgacagcccttttttctcctcttagtgctaagcacataaaataacactatgcttatatcttagactgcatcttaaatatgaggaaatatagtagttgagatgattaatgttaaatgcaaaaatgccaaaggtatcttttagtgtagtttatctgaaatagagagtatgttgaaaggagtaatgtgaaattaggctggaagaaagatcctagctttctagagaaccagattgatgaatgaaatgtgggtactatgtgaagaagagtgtttatataacaatgtgaaatttattatttaaagaattattgtttctgtaattgaaatcaatcttatttaaatttttattttttaaaggatgagaaaaatcagttaatgacaacaaacgtctggttgaaacaggtatgtgtgtaaaattcaaacgggcacccaattagtgactgggacacctatttttattatatgtattgtagcagaaatacaagagtatgtatatttgtgaatacaaatgaatacgtgactatatggccttggtggattggcaggacacagaaagatgagggtagatggagttcttgtatttattcagctagtatttttggagtgcctattgtgtgccagacactgttatggggaaacagcagtgaacaaaacagacaaaaaaccctgtagtattagtccgttctcacactgctataaggacatacccaaggctgggtaatttataaagggaagaggtttaatggattcacagttcagcatgactggggaggcttcacaatgatggtggaaagtgaaggagaggcaaaggcatgtcttacatggcagcaggcaagagagcatgttcaggggaactgccctttataaaaccatcaattcaagatgagatttgggtggggacacagccaaaccacatcacctgccctcatggaacttcattctagtgggggaaaaataaacaagttgtatagtaccttagaagctgataagcttggggaaaaacacactggaaaagaagatagggagtattggggtcgggggtgtacttataaaaatggtggtcagagaaaacagcattgagaagataatgtctgaacaaagtcttggtggagaggaagcaagccatgtgtatatctggggaggagcgttccaggcagcaggacctacaagtgcaaaggtttctgagctggtgtgtgcctagtgtgtttaagcagttgcaaggaggccagtgtggctagcagtgagagaaccattggggagagggggtgtaggagatggcatcagataagcaagaagaggctggtggagtagcagctgcttataggccactgcaaggattctgactctctaaggtggaaatgggcaagaatgaaatgaatttttttttaatagatagtcccttttatataaaggacttttgtttttttctgggccaccatacatatgtcctaactgctgttgagcgcttccttttgtttttatcatccctaatttttatacctactatttgttttctaaccccgaactcctgaaaggcatatatgcttttctcagggtgcagctcctaacttgatcacagaattgtaactgcatggaggtagggtaaggtgttgaaatacgcagaatgtgcaataaatccaactcccttttgcatggaccagaacagccaaattgggtgacaatacatctggaaaaaagaatgtttcccttgaacctggatattaagtgcctgtggcttcaagtcctggatatagtcagtcagttgatgggagaagagttgccgagcagagccatgaacacatctagctctggttctcacctgtgtctcacagggaccatggtgagaaccactacacaaggggacagggttatctggtgcccataataagaaagacagggaggtgttctctattgggggtagagatgatctcatgtctaaaatttctggtgtgacaaaaaagtatggtattcactgtttttgactattagttttattgaaattgaggcagatttctttgttttaaaggaatggatagatgtaaaattaagatggaaccctgatgactatggtggaataaaagttatacgtgttccttcagactctgtctggacaccagacatcgttttgtttgataagtaagttatattctaaatatagttttatattttcaaaagaaaacatttgtatttctattaggcactaataatttttctcccttttgaaattgtttaggtataaaaatcaaatgacatgaccgcatgtgcctgggtatgattacatgttttatagatgaggaaacagaggcttagggtggttgttcttttccaagatcacagagctagcacatggcagagtaggggggtcacaccaaggggactgatacctccatttactctttgttttactagactacatatttggcagacttctagatttttttgtatgttttttacgtcgttgaggtcatattttatgttgaattgtgcatccttctagttgtgtttaaatactgtatcgtcattttcccacaatgaggaatgctgggttaattatcaattcatctttagaggcatcctacctaggtgtgttttgaggatttttttttttttaacttaggggagaggaaaattctgggtaccagttttatttttttctaagaccactcctgggcaaatctgggaatttgtgcttatcttaaagcactttgtctgattcgaaagaaggccatttggcatgaggacagagcaactgctatgcaaaaatatctttaatcttttgacactttttacctccatgcttcttaagaagtgaacaaagcttgtaaggacacatgatgcagcttcctggagcatcattttattttcagtaattgaaaacatttttatattaaacatggatatattacagaatagtgtgcaaaagccacatgaatttgaagacagcaacattttaaagaaatcttatgttggtggtgtgctttcctagtatatggattctatactagacttttctcatatatgaattcacttggtgggagagcttgagaggcatagctgcttttcagggtcatgcccagcttggtgttcatggtctttccccatcaaagtaaaaaacggccagtatttgcgatgaaggaagaagagcactgtggagggagtctaggagtgtggattcaggttctggctgtatgcgtgcccattgtgtcaatagcctgagtctattctgtgtgtaaggtgaggtcttttcaatcattagaatctcaggcttctgtgaaaatttgtcagttctggagtagatgcagaagaaggggttcagttctagtagagttagatatttaaggaagatattcctggagcagggtccctatgtagcacgtatatcttatctgaagtatagtaatttaaaaattatttcatgcaatcaatgataggcctgcttttatattaggcttatattaatacaattcatgtgcattgtttaatttctgcattgttattttatatgtgtgtattttagtgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggtctgtgatgtgtatttacaaatgcagatcttcttccattttaagttcagaagttactttcattaattttggcagagtaaacagcatgacccttaagtaagactaagcatagattgagggccagaattgttgacatattttctataaaagatctttactaaggcttgtttcagttaaagcacctgcaaaatggggcatttacacaaatctcacttctccacttcccccatcagcatcttggataactctaaagaaaatttagtgttatattctaaggaataatcctgccatatttcttggctctgacctgatgaattgttttaatttcttggggtgagggcagtgggtgaactgttttaattttgtcttcagtaactttgtttctaaattgtgataatctgtaggcagaactccattataacagttaatggagttatcaaaagttcttttaggctgggcgcagtggcttcatgcctgtaatcccaccactttgggaggccgaggtgggtggatcatttgaggtcaggagtttgagatcagcctggtcaacatggtgaaactccatttctactaaaaatacaaaaattagctgggcatggtggcacatgcctatagtcacagctactcgggaggctggggcaggagaatcacttgaacccaggaggcggagattgcagtgagccgagatcacgccattgcactccagcctgggcgaccgagcaagactccgtctcaaaaaaaaaaaaaaaaaaaaagttcttttaaagaatgagcctaatgtggaatttataagtataaaattcagtcttgtcactgttatttcttctattgtgtattattttaaacctatgactatagtaatattttcataattgaatgtacattaaaattatgtgaattataatctgtaaagctattttaaatggaaaatttccatcaggtatgaggagacagaataaatctggcaaaatcacagcctttatcccaaaagggacatttgatgtatatatttttaaaactttttttcatatgttaatgatttaatttcaataagactttccttccttattttattgtatttcaataggtttttggggaacatgtgtttggtcacatgcataagttctttcatgctgatttctgagactttggtgcacccatcataaaaacttctaatgcttgtgggtttgtgaagtatctatttggtggtagcataatgaaattagtttataaggtttggagctatcattggagtttttaaaagtacatagatttgttaggtaatggtttagactgagatggaatttaataaatgtctgcaaagtattgtgcaaaagggtcatggctcatactactaggaccaaggaggttggttttattttcagataaaaacagaggcagaggtggccaggtgcggtggctcacgcctgtaatcccagcactttgggaggctgaggcaggtggatcacgaggtcaggagtttgagaccagcctggccaatatggtgaaacactgtctctcctaaaaatagaaaaattagctgggcatggtggtgtgtgcctgtagtcccagccacctgggaggctgaggcagaagaatcacttaaacttgggaggcagaggttgcagtgagccgaggtcacgccactgcactccagcctgggggacggagcaaggctctgtctcaaaataaaataagcagagaagtaacagggtttacaatgccctaaattctaaattatcctacactttggaggcacagttcccatagaggacaccatccttcatagaggttcagggccagggaagcccctggtcaaggaaatggccttgtagaaaggggagcccctgctgcttagtggctgggctcatccttctttttccttgtggtggctccgagctgctgagccagctccctactaaagctggctccagggaagactgttctgtgctcatgaaattagactgaagtggtccctaggaaatccaaaaataaataaagtgtgtatgtgaggaagatgaacagctttctaacatgtattattctgaaccaacttttaatttggcatgaaattaatctcaggctagagtctctcaaaatattaaaataagtaaacactactgggcaagaataagtatatatagtaagaataattttttttagtttattgtaaaatatccaagtctattttaatttttaatctatcaaaataaaccacttgtaatataagttgatgtgtaaatgaacatattttgtagtgtcttttaaagcttatatctatagtagaccttcaggctagtgtctgtccctgagctgagtatagggtcacttaccgtttagaggcagcaatgggaggcagaaatcgatttggcttctaactcagtgtgtttgttatatcttaaaatatgtacacaatttacaattatttaatgcatttttatttttttcctaacaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgtactcactgagtaacagctaatctttaatataatattatactgctatatttaaaaagctgactacttgatataattacttaatgtgatgcttgatataataattacttaatgtggccgggcacggtggctcacacctgtaatcccagcactttgggaggtcgaggtgggcgtatcacctgaggttgggagttcgagaccagcctgaccaacgtggagaaaccccgtctctactaaaaatatgaaattagccagggtggtggtgcacacctgtaatcccagctacctgggaggctgcggcaggagaatcgcttgaacccaggtggcggaggttgcggtgagctgagatcacgccattgcactccagcctgggcaacaagagcaaaactcagtctcaaataataataataacaacaacttaatgtgctgctgcttttccataaccaacattttaaaaataaatgaaaaacaggaattgggaactcctttaaggcttactttattctttagatgcttaattattgtgttaactatttctgtagcttagcttccactgtaaagtcatacagtagacaactcctgtggacacgcagtagcatatccttaacattaatttcagtcctcttgtccacatttcccacaattaatagaaccatcttctatataaattgtggtagtatctctttatccttgatcttagaatagtcagtccactacaattacatgaaccccatttaaaaaacatatttagggccgggggcagtggctcacatctgtaatccaagcactttgggaggctgaggcaggtggatcaccagaggttaggagttcgagactagcctgaccaacatggtgaagccccgtctctactaagaatacaaaaaattagtcgggcatggtagcaggcgcctgtagtcccagctactcaagaggctgaggcaggagaatcgcttgaacctgggaggtggaggctgcagtgagccgagactgcgccattgcactccagcctggcaacaagagcaaaactctgtctcaaacatattttggtctaaatcattctgtgagaaaacaatcttctaatatgaaacacagtattctaatttggtatatgcacactgttatatacctgtaatatttcagttttctctccttcattctaacaattacaataatagaatcttagagttgcaagggcctttagatgtaatcaatcttagcctattactagtacagcgtaaatgatttagtacagtataatgtatcacagttaaaacagttaaattccatctctaaatgtcaccacttcaggtgtgaccaggtagcaaacactgacagaaaccctcgttcaatttagaactcttagctgttgagatcacaaacacctcatttatttataataagtaacctatctaagttcaagccaatgctctttggaaggcggaggagaccctatctaatttgcatttaatcgtaggcaggtgtttaatgccatttaatgagtgaaagcctggtgtgatgaatttagattgcctgccagctacctaccttagttcgtatacatccctgatccctcttatactaccattactgttacttatgatttttatatataaatttttatcgacatctttcttttgacttattgaaacatgagtcacagcgggctgcaattctgtccattttatttttgcacaggaaaaactagtgagacaagattcaaacagtctctgtgaatcatctgtcagtggtgatgatcacgttaagtttcagaagtgtagtacatgatactcttaacaatttgtctaaagcaatgtttctcaaccaggggcaattttgctcctaagggaacatttaacaatggagacattcttggttatcataactggtgaagaagcaaggtatgtcattggcatctagtgagttgaggctagggtactgctaaagatcctacaatgcacaggatacccccattctgtaccaacacatatttatccagcccaaaatgtccatagtgctaaggctgagaaaccctgttctaaaggttcatgctgtggtccaaatgtgtcctcccccaattcatatgttgaaacctattcccagcgtgattgtcttagatagaaggtggggccttggaaaggtgattaggccatgggggctctgctctcatgaatggggttagtgcccttataaaatagaccccacagagatagctagtcccttcagtcatgtgaggacacagctagaaggcaccctttgaggaagaggaccctcaccagacaccaaatttgctggtgccttgaccttggacctcccaacctccaaaactgagaagtttctgttgtttataatccacccagtttatggtgtactaagacagttatattaacaatgaataactaggcatgatttctcatggtataatttagaagtatgcaagagaagtagttgaagctctctgaaatggaggcatagccctttagacccagtaaagaacgagaaatgcatggtaagaaatgggtaacgatgggggattgctgaattagtataaaccttcaaagagattatgggctaaataagaaaaattactgggagatctgtagtgataactgaatgacttttcatatttctgaacagcatttttctatccagttttgtttcaacaactaaaaggaaacatttttacatgtatattccatagcatagcatactaatcacatagaatcacattttgacatctctttaccataccaaaaaggctagttaaatgttcatttatcggtaataaatactcttgacatttttttttttgcatgattccaagataagtggaaaataagtaaacctcgaaatgccaaaaacaaagctggtagcttgataacagaaagtacgttcttactaggaagcagcctcctcctgccctgacacaaggaagtctcccaggcaggcacacagcttagtgcttatgcatcttccctggccatcaggggttgcagaaacaatcctgctgtccctagaatgcacaccagggtgaaaacccacagaaaaatacgatcaatcaccatggcaacatacttccaatcatcttgaatctgcaaaacaaaatgataaaagaaaaaaaacatggagggaaaggcaaatgaatacattttcaatactgaagatgtaatcaacacgttgcagtagaagccattttgtctctaatatgtaagaagccctttttttcctaattgatgtggtctgaggaaatccaccattctcaagtttctgtttatgcaggagagaaacaggtataaaagatctgtcatgttagatctgtttcaaatcagaagtttcctaaaaatgcataacctagtttttctaaactgaattccaattttataaagttagtgaaaccagttacttaggcttccatggcaggattctgggccttggttagaatggctaatatagtccaatataatctaccattgtttcaaagtactctatccagttttagatataaatttggcgcagtggctcacgcctgtaatcccagcactttgggaggctgagatcacctgaggtcaggagtttgagaccagcctggccaacatggtgaaaccctgttgaaaccctgtctctaccaaaaatacaaaaattggccaggagtggtggcacatgcctgtaatccccagctacttgggaggctgaggcatgagaatttcttgaacccgggaggcggaggttgcagtgagcagagatcacgccactgcactccagcctgggcaacagagcgagaccctgtctcaaaaacaacaaaataaatttccttttaacatctgttccaaaaatgagataagcgttatcagggcaagtccatcctcatcactctttccctccccactgccctctccacgatgcccagctgatcaaaagtcatttttactcataagaccaaagtatcatgggatactgtgcagttggagagcaggttgaacatcagaaataattgctgacaataaagtaaaagatgggagaaaaagcaagaccaattgtatataatacagcttcaatttgggcttgaaataggaaggaaaattgtaattatactcctagacaattcagaaagcaaagaagccataattgaattgagagaacccatgagtcagctgattttgaagcaataatgaaattaataaattacatgctgcctctttattataagtatactgaaatggcgctgggagatgaagattttacatcaccattgtgagcctgagtaaatgtgttctcttggtgacactactgtcataggtaaaattagaattatgatgccatatttgccatgaggtacttcatttgaattcctaagactggtttgtgtgtgcttcagatacaccttgagatgtgagattcctacccaccccctaccagccacctcctaaggctctaggaggcagaggtgtggaaaagcagagacttggagacaaactgattagaatcccagctctgctccttttgagttgtgagaatctgggtaaattccatgaccgctcttagcctcaatttccttatctgtaaaatggggataagaacagtacttccctcagaagcttgtttcagaacagagtccttaatgaatagagcctagtgatactaatgttgatttataaaatgacccttactcaagcctcatgaagaaagatgacacttgggttttatacatgaatagaaatagtggtgcaaaaagagctggctggacagaaattttatatcttttttttttttttgagacagggtcttgctttgttgctcaagctggagtgcaggggtgcaatcatggcttgctgcagccttgacctcccgggctcaagtaatcttccccactcagcttcctgagtagctggaactacaggtgtgtgtcactacacttgggcaattttttgttttttgagacgcccaggctggagtgcagtggcatgacctcgcctcactgcaagctccacctcccaggttcaagcaattctcctgcctcagcctcttgagtagctgggattacaggtgcctagcaccatgcccagctaatttttgtatttagtagagatggggttttatgttggccaggctggtctcaaactcctgacctcaggtgatccacctgccccagcctcccaaagtgctgggattgcaggcgtcagccactgcacccggcattttttttttttttttgaaacggagtctcactctgtcacctaggctggagtccagtggtgtgatcttggctcactgcaacctctgtctcccgagttcaagcaattcttgtgcctcagactcccgagtagctaagattacaggctcatgccaccaccaccccccggttaatttattgtatttttagtagagatggaggttcaccattgttggccaggctggtcttgaactcccaacctcaggtgatccacctgcctcggcctcccaaagtgttgggattacaggcgtgagccactgcacctggcctgatttttaaattttttttgtagagaaagggtttccctacgtggcccaggatggttttgaactcctgggctcaagtgatcctcctgccttggcctcccaaagtgttggattacaggtgtaagccactgtgcctggcttatatctagctcctaaagtctttaaagcacaatgatattggccattttctgatgagtcacagatgttaggcaaagtggtgaactagcccaaattgagagctggcccagaagcatgagaagactactttaaagacccagaaactgggaaggtgtggccagagactggggctggcagggggaggggcttggtggaggggagagctagggagatctttgttcccctgccactttgcctctttagcctgccactcccagcccagagatgcaggttcagggggtccctcacaagcccagcagagcctggctaaagggaagtgcagagaactgagctgcccattgactggtggagcctgaggctttcctcctctcctttgtagccccctggatttatttctcttcttattggcatgccttctcaagaatgtttatggataaatgttcttctgagggctcaaaaggccaggtgtggtggatcacacctttaatcctagcactttgggaggccaaggcgggcagatcacctgaggtcgggagttcaagaccagcctgacaaacatggcaaaatcccctctctattaaaaatacaaaaaattaggcatggtagcgggcgggtacctgtagtcccagacacttgggaggctgaggcatgtgaatcacttgaacctgggaagcagaggttgcagtaggcagagattgtactactgcactccattctgggtgacagagcaagactccatctcaaaaaaaaaaaaaaataggtaaaactaatcaattatcaaataagtcagtataatggttttttaaaaaattaattaattaattaaagaaaggacttcactctgttacccaggctggagtgcagtggcatgatcacagctcactagacttcctgagctccagtgatcctctcacctcagcctcctgagtagctggaactacaggcacgtgccaccacgcctggctaatttttgtatttctgttagagacggggtttcgctatgtttcccaggctggtctcaaactcctgatctcaagccatccacctgcctcagcctcctaaagtgctaggattacaggcgtgagccactgcgcctaagccaggatggtgggtaccaagcagggagggagacactgactggcaagggcattggggaactttctaggggccctgggagtgttctatatctttacctgggtcttggttacatggttgtatacatgatgtaaaaactcattgagatgtacactgaagaggtgtgcactttactccacgtaaattcttcctcagtgagaacacatatacaattagaaagtaaaaataaaggccaggtgcggtggctcatgcctgtagtcccagcattttgggagactgaggtgagcagattgagtcgaggagtctgagaccaacctgggcaacatggcaaaaccccatcggtacaaaaaaattagggtatggtggcggggcatctgtagttcaagctactcgggaaactgaggtgggagaatcgcttgagctgggaggcggaagttgcagtgagccaagattgcgccactgcactccagcctgggcaacagagcaggaccctgtctcaaaaaaataaataaaaataaaaatataacctcaattaaccaatactaactggagatcatctggccccatgcccttttccagcctacatcctaatctagtctattggcatcaggtgttttcatggtccagcctgccagcctgctggcagcctggtggctagcttcagggtaccacataccaagctttatcatcccattttacagaagagaaaacaggctcagagaggtgaggtaacatacccaaggacatataactggtcttaacacaggccactgactccagagggcaatttcttaaccccctaccctatgccttgccccacgaggaacccataaatatttgttgaatgaatgaatgaccaatgtaataaaagccatatccttacctctttggcttcattttgtgctttcatattttcagcaatatacttgacactttggatggcttctttgatttctggtgacaaagcagagagggacagcacagcatcaacagattcagaactagagcttctcgtgaggttagcactgaaattggagatttttatcctgcggtggtggcagtaaccacacatcccgtcctggcaggggtagccctccttgcagcctttggactctgcgcggctgaagcaattcagatttgagagctcggcaccgtagaggggcctcggcttctgagcgttgccctcgttgcttgttggcctggtcatgaacatgaccctggggagcaggttcaagaatacagtcttcacccatgagggcattgtgtgtgtcgtcggggttctgtagtgcacgttgagcacgaagacggtgatgacgatggacaaggttacaaaaatcatggtgaacaggaggtactctccaatcagggggatgaccagcgaggtggaagggatggtctcagtgatcaccaggagaaacaccgtcagggagaggaggacagaaatgcacagggtcaccttctcaccgcagtcggagggcaggtagaagacgagcacagtgaggaaggagatgagcaggcaggggatgatgaggttgatggtgtagaacaagggcaggcgccggatgtacagcgagtatgtgatgtcggggtagatctcctcgcagcagttgtacttgatgtcgtgtttgtagcctggggctttgatgatggcccactcgccgctctcccaatagtccttgaggttcatggaagagccgatcaggaccagatcgattttcgccttatcgtaggaccaggaaccgaacttcatggtacagttttggtaatcaaacgggaagtaggtcacgtcgattttacaggagctcttaaagatggccggaggtatccaagtcacctccccagtgtacttgagtaaggctttggtcttgtcgtccacctggaaatccccaacagcactgcaaagacaaagagggggcacagtgacacacggtcattaacacttggtcatattgtggtcatctcaaccagcttctcacagtaagtaatgatttggaaggcactggaagatgagagctaaagtgccataaaaggtcacccatttcctggccccatttaccaacagggatactgaggcccaagctccctccccaacaacaatctgagatatggatcactccctgccccagggcaggccaccagttcatcccacaatacaggtcccaaactgatagactcccaaatgcccgaagaggattggtccccctttaattaaagaaatgggaggaaggtcatcctcctggagccaggtgctgaagcagcctttgggattatttgccacccagggtccctgaggcttggccctctcctcattcagtctgtaccgggcgcctaatgtgtgtgtgaaaccagactatggatgtggaaggggctgcacagaccacccaggggagtccacccccattaaacggaaccttgtcagatggatttacttccaaaccctatctctggatcctgatttgaccattccctgtaccctccccacccccattcttcccagtactgttttacaataatcatgttttgcttccttgtctttcgaattcagcctaacaggtttcttcactttctgtgtccctatccccattttctccccatgtttcttctcccttccttttcactatgtgcatcctgacatttattttcacacagaaatagacatttttctttttctttgagacagagtctcactctgttgcccaggctagaatgcagtagctcactacaatctctgtctcccggggttcaagcaagtctcctgctcagcctcctgagtagctggaattataagcatgtaccacaaacgctcagctactttttctatttttagtagggatggagttttgccatgttggctgggctggtctcgaactcctgacctcaagtgatctgcccacctcggcctcccaaagtgctgagattacaggcttgagccactgcctggccttagacatgtacgtttttctaggaatagtcttgttggtttgttcgacagaaaatcagctgatgatccctgttgagtcttgcattgggcattccatccgcgatggccagatgaggccatctgagagcaaggccagttgcttccacaacaatggccctgcccaggaaggttcttaaacattcctcggatcagccctgttaagtttcttagccttgtgaaggcatttacatcctccaaagggagcaactgccatactcctttgccttgtaaacaatgacaaagcctaaacatttagggatatccttgtgctgctgtaattggatgggaacctgtgaaaacagaaggggaatgttgtggtgcatgtgcttcttccttgctagtctctcctgggtctcggttgagcaggatcattacccatgaaggctcaatgccaaagccactaactatctttcctctggttggctagtttgcccccaatggtgccctgctgagtttatacattcttagccccaatttcactcccaccatgcccttaattccctacgagtattcctgctcctggctccaggaaaaagggagaggtaggagggtggggtggaggtgaacatccacacagtccccaagtggactcagcccatgtttagcactgaggggccctggagagggctgggctaagcagaaggtcgaaaagaccctcaggaaggcagaggcctcctgaaccaattccatacagcatcctggatcaacaaaatgtcagagcggcaagggagcttcagagcccagggtctggtccaggggttggcaagctgtggtcctctttctgtaaataaaatctggggggaatagtgccactgccttttgttgtccattatctatagctacttttgagctccaggggcagagatgaatagctgtgaccgtcactgtatgacccacaacgcctaaaatatttattctctggccctttagagaaaacatttgctagcccctgctctagtccaacaccttcattttgccaaagagaaaactgacggtcaaaggacaggaatgacttgctcgagactccacagagtttatggcagaaccttggccattcagaacttgggtccccaagtgaggagacacagaaatgtgtgcatgtgcccaaagaacatatactagaggttagctgagcttggctgatggctcatttctggggatcctggtcactgtggctgctgcccacagcacccctggggtgtgtccacccagatcagaaggcctgtgtgctgcctggggcagtgtcaacagtcatatctctactagcagaagacagaacatgcagacccagctggagactggggtctggcacagcaccagcctcataaagggcactcagtaaatatttgttgacctaacgaatgaccaaaaaataaatgaaagctgggtgtggtggctcacacctgtaatactaatactttgggaggctgaggcgggcagatcacctgaggtcagcagtttgagaccagcctggtcaacatgacaaaaccccatctctactaaaaatacaaaaattagccaggtgtggtggtgcacacctgtaatcccagctactcgggaggctgaggcaggagaattgcttgaacccaggaggtggaagctgcagtgagctgagatggcaccactgcactccagcctgggtgacagagtgagattctgtctcagtcaatcaatatcacacccagagatagctggcagcaagggacagcattggtgggaagggtctgagcaatgtactgccaaaccatgtgaggcaattaaaaaaagaaaaggtagtatgggtgcaaatgatcagctgaggtagcactatcatacagggggcatttaagaacagaagtggggtggggtggtgagggctatgagaaagatcatgatggcatgggtttttaaaatctctctaaatttcttcagaaaaatagggcaactaggatgacagcaaaataacaaatctgatcacattgtcaacaaagttaggttacacagcacctcaggatatgagagtgtgcggtcagaccaccaccaccagcaggacctgtgggacccacatgcgattagctgcggggtagaggcagccgggggaaaagaaagaagggttctcatgtcctaagatcctaagagtgccagacacaggaatctccaaaaagtggctgcccctcaaaagacgaggaccccactctgcactgaatcctcagcaaggggaacaatggaacagagagggctccacaggttccaatttgtgggcaagaaccaaaaaaatcccgtgggaatccactcagtgtctgcagaggtcagtcagtgctgacgtgggctcttgaggatgtcagaaatgcctcccaaaacctccctttcagaaggacagagacccactcagagaaaaagctgcttatggtagaatccaaactcaacagggtaagaagtggggatgagaagagaaagaaggttcagaaactgaagtcagcatccagaggcagcagctcgtggagatgccatgactgtgcggtcatgtcatgactgaggtgtcatgactgtggagactggggaggtggccatgcattgagacaagtggcacctcaaggtaactaccgtcttctcctattccccccaagaacttgccctaaaagtaaagcaaggctatctatttaaacaagagcaacgaagctttatgaaaacatattgtaagaaaaacacaaactgggtacagcagctcatgcctgtaatcccagcactttgggaggctgagacaggtggattacctgaagtcaggagttcgagaccaacctggccaacatggtgaaaccccgtctctaccaaaaatacaaaaaaaaatttagctaggcgtggtggcagtcacctgtagtcccagctacttgggaggctgaggcagaagaattgcttgaatctgagaggcagaggttgcagtgagccaagatcatgccattgcactccagccttggtaacaagagcaaaaaaacagaagatgtctcaaaaaaaaaaaaaaaaatacaaacacaagtaactgaattaacacacacgcagataacagcaactacaaaaatagagccaccaagcagatgaagctgacgataatctgatattacaaattaaatgaaaagaaactaagaaatttttcaaaattgtgaaagaacagaaatcagaaaagataagggataatttggttaaatgaaagaatgtataaagaactagcagaatttaggaaagaattaggaaaaagaaaaaaatcattttagaaataaaaccagaagaggccaggggtggtggctcaggcctgtaatcccagcactttgggaggccgaggtgagtggatgacgaggtcaggagatcgagaccatcctggctaacacagtgaaaccccgtctctactaaaaaaaatacaaaaaaattagccggatgtggtggtgggcacctgtagtcccagctacttgggaagctgaggcaggggaatggtgtgaacctgggaggcggagcttgtagtgagctgagatcatgccaccacgagagtctgtctcaaaaaaacaaaacaaaacaaaacaaaaaacacacaaaaaagaaaaccagaagaaacataagaacaagcagtctgggtgtgatggctcacacctgtaatcccagcactttggaaggctgaggcgggcagatcatttgaagtcaggagtttgagaccagcctggccaacattgtgaaaccccatctctactaaaaatacaaaaaattagctgggcatggtggcacacacctgtaatcccggctactcaggaggctgaggcaggagaatagctggaacccaggaggcagagattgcagtgagccaaggcactccagcctggccaacacagtgagactctgtctccaaaaaaaaaaaaaaaaagattttcatggaagataaagaggagccaagaattttacacccagccaagttacctaaaagtattctctaaaaaggttacaatgaattatgaacttgccagaacacagagtatacagtgtccatgaatactctgaggattctgtcagcaaatgaactttagaaaacaaaatatcacaggagaaaggctgggaatgatggctcacacctgtaatcccagcactttgggaggccgaggagggtggatcacaaagtcaggagattgagaccatcctggctaagtcaggagattgagaccatcctggctaaaacggtgaaaccccgtcgctactaaaaaaatacaaaaaaattcgggtggagccaaaatggccaaataggaacagctccggtctacagctcccagcatgagcaatgcagaagatgggtgatttctgcatttccatctgaggtaccaggttcatctcactagggagtgccagacagtgggtgcaggatagtgggtgcagcgcactgtgcatgagccaaagcagggcgaggcattgcctcacttgggaagcacaaggggtcagggagttccctttcctagtcaaagaaaggggtgacagatggcacctggaaaatcgggtcactcccaccctaatactgcacttttccaacgggcttaaaaaacggcacaccaggagattacatcctgcaccttgctcggagggtcctacacacacggagtcttgctgatggctagcacagcagtctgagatcaaactgcaaggcggcagcgatgctgggggaggggcgcctgccattgcccagccttgattaggtaaacaaagcagccgggaagctcgaactggatggagcccaccacagcccaaggaggcctgcctgcctctataggctccacctctgggggcagggcacagacaaacaaaaagacagcagtaacctctgcagacttccctgtctgacagctttgaggagagtaatggttctcccagcacgcagctggaaatctgagaacgggcagactgcctcctcaagtgggtccctgacccccgagcagcctaactgggagacaccccccaagtaggggcagactgacacctcacacggccgggtactcctctgatacaaaacttccagaggaacgatcaggcagcagcatctgtgggtcaccaagatccactgttctacagccaccgctgttctgcagccaccgctgctgatacccaggcaaacagggtctggagtggacctctagcaaactccaacagacctgcagctgagggtcctgtctgttagaaggaaaactaacaaacagaaagcatatccacaccaaaaacccatctgtacgtcaccatcatcaaagaccaaaagtagataaaaccacaaagatggggaaaaaacagagcagaaaaactggaaactctaaaaatcagagcacctctcctcctccaaaggaacatagctcctcaccagcaatggaacaaagctggacggagaatgactttgacaagttgagagaagaaggctccagacgaccaaaatactccaagctacaggaggaaattcaaaccaatggcaaagaagttaaaaactgtgaaaaaaaaattagacaaatggataactagaataaccaatgcagagaagtccttaaaggagctgatggagctgaaagccaaggctggagaactacgtgaagaatgcagaagcctcaggagccgatgcaatcaactggaagaaagggtatcagtgatggaagatgaaatgaatgaaatgaagtgagaagggaagtttagagaaaaaagaatagaaatgaccaaagcctccaagaaatatgggactatgtgaaaagaccaaatctacatctgattggtgtacctgaaagtgacggggagaatggaaccaagttggaaaacactctgcaggatattatccaggagaacttccccaatctagcaaggcaggccaacattcagattcaggaaatacagagaatgccacaaagatactcctcgagaagagcaactccaagacacataatagtcagattcaccaaagttgaaatgaaggaaaaaatgttaagggcagccagaaagaaaggtcgggttacccacaaagggaagcccatcagactaacagcagatctctcggcagatactctacaagccagaagagagtgggggccaatattcaacattcttaaagaaaagaattttcaacccagaatttcatatccagccaaactaagcttcataagtaaaggagaaataaaatactttacagacaagcaaatgctgagagattttatcaccaccaggcctgccctaaaagagctcctgaaggaagcgctaaacatggaaaggaacaactggtaccagccactgcaaaaacatgccaaaatgtaaagaccatcaaggctaggaagaaactgcatcaactaacgagcaaaatcaccagctaacataataatgacaggaccaaattcacacataacaatattaactttaaatgtaaatgggctaaatgctccaattaaaagacacagactagcaaattggataaagagtcaagacccatcagtgtgctgtattcaggaaacccatttcacacgcagagacacacataggctcaaaataaagggatggaggaagatctaccaagcaaatggaaaacaaaaaaaggcaggggttgcaatcctagtctctgataaaacactttaaaccaacaaagatcaaaagagacaaagaaggccattacataatggtaaagggatcaattcaacaagaagagctaactatcctaaatatataggcacccaatacaggagcacccagattcataaagcaagtccttagagacctacaaagagacttagactcccacacaataataatgggagacttcaacaccccactgtcaacattagacagatcaacaagacaaagttaacaacgatacccaggaattgaactcagctctgcaccaagcggacctaatagacatctacagaactctccaccccaaatcaacagaacatacatttttttcagcaccacaccacacctattccaaaattgaccacatagttggaagtaaagcactcctcagcaaatgtaaaagaacacaaattgtaacaaactgtctctcagaccacagtgcaatcaaactagaactcaggattaagaaactcactcaaaaccactcaactacatggaaactgaacaatctgctcctgaatgactactgggtacataacgaaaggtaggcagaaataaagatgttctttgaaaccaatgagaacaaagacacaacataccagaatctctgggacgcattcaaagcagtgtgtagagagaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaagatcaacaaaattgatagactgctagcaagactaataaagcagaaagaagaatcaaatagatgcaataaaaattgataaaggggatatcaccaccgatcccacagaaatacaaattaccatcagagaatactacaaacaactctacgcaaataaactagaaaatctagaagaaatggataaattcctggacacatacactctcccaagactaaaccaggaagaagttgaatctctgaatagaccaataacaggagctgaaattgtggcaataatcaatagcttaccaaccaaaaaaagtccaggaccagatggattcacagctgaattctatcagaggtacaaggaggagctggtaccattccttctgaaactattccaatcaatagaaaaagagggaatcctccctaactcattttatgaggccagcatcctcctgataccaaagctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaacaaatgtaatccagcatataaacagaaccaaagacaaaaaccacatgattatctcaatagatgcagaaaaggcctttgacaaaattcaacaacccttcacgctaaaaactctcaataaattaggtattgatgggatgtatctcaaaataataagagctgtctatgagaaacccacagccaatatcatactgaatgcgcacaaactggaagcattccttttgaaaacgggcacaagacagggatgccctctctcaccactcctattcaacatagtgttggaagttctggccagggcaattaggcaggagaaggaaataaagggattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttacacgccaataacagacaaacagccaaatcatgagtgaactaccattcacaattgcttcaaagagaataaaatacctaggaatccaacttaagagggatgtgaaggacctcttcaaggagaactacaaaccactgctcaatgaaataaaagaagatacaaacaaatggaagaacattccatgctcatgggtaggaagaatcaatatcgtgaaaatggccatactgcccaaggtaatttatagattcaatgccatccccatcaagccaccaatgactttcttcacagaattggaaaaaactactttaaagttcatatggaaccaaaacagagcccgcatcgccaagtcaatcctaagccaaaagaacaaagctggaggcatcacactacctgacttcaaactatagtacaaggctacagtaaccaaaacagcatggtactggtaccaaaacagagatatagatcaaaggaacagaacagagccctcagaaataacgccacatatctacaactatctgatctttgacaaacctgacaaaaacaagcaatgggggaaaggattccctatttaataaatggtgctgggaaaactggctagccatatgtagaaagctgaaactggatcccttccttacaccttatacaaaaattaattcaagatggattaaagacttaacatgttagacctaaaaccataaaaaccctcgaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatattcagaatctacaatgaactcaaacaaatttacaagaaaaaaacaaacaaccccatcaaaaagtgggtgaaggatatgaacagacacttctcaaaagaagacatttatgcagccaaaaaacacatgaaaaaatgctcatcgtcactggccatcagagaaatgcaaatcaaaaccacaatgagataccatctcacaccagttagaatggcgatcattaaaaggtcaggaaacaacagatgctggcgaggatgtggagaaataggaacacttttacactgttggtgggagtgtaaactagttcaaccattgtggaagtcagtgtgccgattcctcagggatctagaactagaaataccatttgacccagccatcccattactgggtatatacccaaaggactataaatcatgctgttataaagacacatgcacacgtatgtttattgcggcattattcacaatagcaaagacttgcaaccaacccaaatgtccaacaaggatagactggattaagaaaatgtggcacatatacaccatggaatactatgcagccataaaaaatgatgagttcatgtcctttgtagggacatggatgaaactggaaaccatcattctcagcaaactatcgcaaggacaaaaaaccaaacaccgcatgttatcactcataggtgggaattgaacaatgagaacacatggacacaggaaggggaacatcacacaccagggactgttgtggggtggggggaggggggagagatagcattaggagatatacctaatgctaaatgacgagttaatgggtgcagcacaccaacatggcacatgtatacatatgtaacaaacctgcacattgtgcacatgtaccctaaaacttaaagtataataataataaaatttaaaaaaaaactgtaaagcagtggcaaacaaacaaaaaaaaaaccaaaaaaaaccacaaaaaaattagccaggcgtggtggcgggcgcctgtagtcccagctacttgggaggctgaggtaggagaatggcgtgaaccagggaggcggagcttgcagtgagcccagatcatgccactgcactccagcctgggcgacagagtgagactccatctcggggtggggggaaaaaaaagaagagaaatccttaacagagggtgaatcctgagcaattgaagttctaactaggagaagagagagaacatgagttggatgattttctctaaatgttattttcagcttcagatttcaaagaaattccttatgatatttgctcctctccacagccaatttgcaacattttgctacgcctctcattattgctaaaatcataaatcctacagtactccagctgttcactcaagattgccagcaaggaaatggctataaaacgcaaaacatgaagattaaactttttgctcattttcttaattgtagcttagcaaaaattctctacaccctgcccagttcccttaagagcatttgaaccatgtgattcctacgacaattcagtgcaagaagaaaaaaatctgcaagcctgttgagtttatattgtgtcccagttctttgatgaccagtttacaaatacaaattacatacaagaaacatttataagtgctgtgtttccttgggaaaacagtaaataaaacatggactgtctttagagtgagtaaagacccacttttgtttttgccagagaccagaaagtgggattcagtataaaacatagcttctctagtcctgacactaactgtaaaatcaatactactaataagaaaacattattttgtactaatatggcataaaaacctagaagtattcttagcattaaaatcagaatagactaattctacatcaactgttttgctgaaaatgtttaaatgtaaatgtaaaaggtttaaatattcaaacattttaactctaaaatgcaggtacaaaaatgatattcttcaatacccagagaactaactagcatattgcaaaatatcaactaaaatttatgtcagtccaatgaaagagcttaaatgtgggaagtatcagttttgtgtggacttagagaaaagggaggggttttggaggtgctatgatgagcaggacctgtctggcagaggaagaacctttgcaagagagaaagaggagaggcctcccaaaactggcgggaagatgcacattccggatccataggagactggaagtggcccactgtgaaggactggctcgagagcagcttctctcgatggcaggagccagggaagtctttttagtcctggactcacccttctcaactacgacctggatgcagccacccagacgggctgggagcacggggcccagaatgctcatcctactctgtacatgggaaccttgcttcacatacttggggggctatcaatcctttctccaaggcccagaccttttcccagtgggaggaggcctgcagggtacaccgtgtagcagggtaactgtctgatggcaggtttgctgttgggagagtagagaagaggtttggggacacaggcagagacaggctggggtgcccagctcagccccctgatcacagcatcggcctcctgcatccactgcccacagtggccccaaagccacagtggatggctgagaccaccccagacctggctgtgccacacatccactctgggcctcagtcctcatctgtgaaatgtcagggaagggccagatcagggatccccaaagcaagctggtcacacagcccccaggacagctttgtgaaaacacccattcctaggcctacccagacccactgactcagtgtttctgtggggcaggacctggggacaggtatagagattttttggataacgtaatacatattaactttagaaaagacagtgaggaacaaagaataaaatattttgaattcaggcacctgtattttttttttttttttttttttgagacggagtctcactgtcacccaggctggagtacagtggtgtgatctaggtcactgcagcctctacctaccaggttcaagcgattctcctgcctcagcctctggagtagctgggattacaggcacacgccaccatgcctggctaattttttgtatttttagtagagatggggttttggtatattggccaggctggtctcgaactcctggcctccagtgatcctcctgcctcggcctcccaaagtgctgggattacaggcatcagccaccatgcctggccaaacacctgtatttttaaaaagctcattggggctgggcatggtggctcatgctgtaatcccagcactttgggaggccaaggcagacagattgcttgaggtcaggagttcaaaaccagcctggccaacatggcaaaaccccatctctactgaaaaatacaaaattagccaggtgtggcagcacgtgcctgtaatcccagctacttgggaggctgaggcaggaggatttcttgaacccaggaggtggaggttgctgtgagccgagatcccaccactgcactccagcctgggtgacagtaagactcagtcttcccccccccacccccccaaaaaaaaagctccttggtaaccatgccagtcagcaggctgggaaccctgggactacacagcttaggcccacccagctatgatcttctccaacaccctcattctctttcaaagacaaggtgaggagggaccgtttactccattcctgtctgtttgcacagagctgctaacagatgctacattccaggtgccccgggcatctgagccttccccctccacacactggggttggtccttggcccatggatctttccagccttatgtcccacagtccagccaatgaggtcaccttggctgcccatgacatactctcctgcctccccgggccctcctctgctccatctccctgtcctgagatcctacacaatcttcaggattcacttcaaatgccaattcttccttgaaactttcccaatgccatcttccacccacccatgcctgctttgaagccactcagcacactgctgctctctgtggctctccaacatctctggtacctggtatgtagtagttgctgattacatacctatggactgaacaaatgaatgcagccttcttggaaaaggccaaggaaggccaggttttaagcacagtgggccaaaaacccagagcccaggctgacagccctgagagggcgtgggccccccagcaccttacttgttatacagcacaatgtctggcttccagatcttctgtgcagggacacgcatgaactctgccccaccatagtcagaggggttccatttcagcttgtagtcattccagatctcggggaaggaagcagggagggagaaggagacggtaaaagaatcagcctggttttacttcccgtggcaccacccatcttggtgactccccacccctgctgcatgtgaccgaaccacatccatgccatgatcacatagtccaacttctcctgtgggtgtagtgcaggagagagcacacggctggctctgcgggccacctcctggcactagggaagccactgcccccataaccatgagcaagcccagcccctcatcaaccaaacagggcctactcgtgctttctctggtcacttctagtgccaggtggagactcctggacttcatgcatcatgtccaggtccatgtgcctgtttacagcccctgaatggctctccaggggtgttttccaacatagacactctttcaccccaaggttaagcaagactggactctgaaagattccgggggaagaatccatgacccctgcagggcccaggaagtgtctgggtccagaggctgggaggtctgagtcctgagcaccagaggagagaggggtgaggctgcggccacagagggaacgtgtgcatcaagtactgggtggggcactgtgcccatctggctttccaacctcctggggatgaaggctgtgtgtgctgagtgctcagctggccaggctggcagaagggtcacccgcaggccaatgggccattatgtctcctggcaagtctggacaaagcctccctggggaggacatgtggaaggcaatttcttggcctcgatctgaacaggaaaatctactcccacgctaccaacaacagcagcatcttattctgacttaagaatgagtataggggctgtgcacagtggcttctgcctgtaaccccagcactttgggaggctgaggtgtgtggtttgcttgagatcaggcgttcgagaccagcctgggcaacatggcgaaaccctgtctctataacaaatccaaaaattagccagacgtggtggtgcacagctgtggtcccagctacttgggaggctgaggcaggagaactgcttgaaccctgctggtggagattgcagtgagccgagatcacgccacagcactccggcctgggtgacagagcgagatcccgtctggaaaaaaaactgagtttttagcaagagggagagaaggaggtgtctcaggcaccaccccagggtttgggggcagggcttcaatctcaggttcgtactcttctgttgtgtgaacatggagaatgtctttctccaggctgcaacctgtccatctgggacttgaggggttgggccctacagtccttccagggggactgtagggcagtgcatgtgacctcaagccttagaagagatatatctgccagtcagtggaccccaatctgggttccacagaagtaaatgaagcctggtctttaggcctttcttggttcacctaaagcaaataaaacagtcaccaccagggggcagcagtgcctagggtctggtcacttacttgcttgagccacaggttggtctccatgatctggtttacttcatcctagaaagaggaattaaagttgacaggagaattacaaaacaagactaattctgggaaaggctcctccagaagccccggtccccatggccacggctcgtggcttccagcactcaccaccttcaccagctgagacatggacacctcgaaatggatgatgactgggtcagacacgttggctacaggccggatgatctcattgtaatcttcaaacagccgctcaaatagacggtgctcagcctctgaggccctggccactgtgggaagcagccctgtcagtccctggggaaatcgttacttaacctcccccacccagcccagcagaaacatcacccatctacagcatcccctccacctgtggggggattctgtggaaccctagactttcaggccagtctaacccagtgggttacaaaatgggaaactgaggcccaagaggggcaggattctacctggccacacgcattcagtgagaagcacagtggttgcaagcctgggctctggagttggacagatctggtgcaaatcctgacaaatcacttgtaagctgtgtgagcttaggcaagtggcttaacctctctgaacctgtgtctttaccagtcaaaataaggattataaacgtatccacctcaaagggttgttgtgaaggaagtgcacagcttggtgctgcggtaagaggtcaagaactattcgcaatcttttcctgggttgtttctgccgggtgggggtgtggggcaaatgctgtctgcctgggtacagccactcactgcttccacgatggaaagatggccagtccgctcccaggggcagggccaaccacggtcgcccaggcccaggtcttctacctcccagcctccgggagaacacagcccaggtctgggcctctcctgcattccaccctgtaggggtggccaccagccctcttagaagccaaggcactgtgtgactcccgtgatctcgtgtgacccccagctcttgctgatgctgtcttcatatcctgatgaaagactctgacctctgcaacccttgggcacccctctttgttcctaagccacaccccagcacaagtgaggcataccgggtcagctgtcttctgattcccacgtacagatctgggggcagcttggggaagcgggaggagaatcctctaggaagttgaatccaacttcctcaggtcttgaaataggatttttcctgctccccactctccttccccaggatgaaagaagggtcccaggcaggaggtcggttgagagcgtatggcgttctgagtagtgcaggcctcggcaccgagggcggaaagcgctctgagctcacagccgcacgacagaccgccggcctgggccctccaggaattccctgcagccttgcccggtccccgactctcgctacccaccagccctcccaggcacccaagagcctcccagcggcgggccagggccggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctccggagccctaacgcctgtgcgcgtacctggcagcagagacagcagcagcagcagcagcagccgcggcggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggccggcggcgtccgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttagccgggagcagtggctcacgcctgtaatcccagccagcactttgggaggccaaggcgggcggatcacgaggtcagagaccatcctggctaacatggtgaaacctcgtctctactaaaaatactctacaaattagcccggcgtggtggcaggcacctgtagtcccagctactcgggaggctgaggcaggagaatggcgtgaacccgggaggcagagcctgcagtgagccgagattgcgccactgcactccagcctgggtgacagagtgagacttcatctcaaaacaaaacaaaacaaaacaaaaaaacttagatatagtactggtattttttttttaagtccttatagcttaggggtgggtggaagttagttgaaacaatattggctatgagttgataattgtcgaggcaggatgatggtacctggaggtttgttatactgttctcttaactttggaatacgtttggattgttccttaatgaaaaattttttggggtgatcagacccaaccccaggccatgggggtgacaaagtcaggcggagtcaaaagaatgagaaaagacaagagagaaagcgggaccaggcggccaacgtatggaggctacgaaggcccccagctgtgggagcccacgctatttattggtgatcaaagaaacaggtggtgaggatgtgggggttgaaaggaagcggtgtatcaagcaaatgaactacagctgtgacggtagttcacctcccatcccaaagtgctgggattacaggcgtgagccactgtgtgcagcctcatctgctcttctgatggagcaatctgagagggcaatggggttcccaccctagtcccctgcagaacctgtccccttccccgccaccatctgcaaccccaagaatgtgcactgattggccaggcagggtgccctggagcctcctgccctctctgaccacccaccagggatggggggcaccttgatgttggcttctttgacatccttttattgcaggaggaagttctgtcataaactctcctcctggcattcagcaaatggagagtcacctttatcatttccagaatgtgctgtttacccatattaaaaccaaacaaaaggagacagtttgtggaatggaaaatgtaagaattgggacccacctctcaggcctccaattacagcattctcaactcttggcaaatgtcccccattgggacaatactgtaagttatatatccaacaaaggacttgtatccagaatgtataaggaactctcaaaactcaacactaagtgtagatgcatatgaggggtcttactggggtgatgcagatgttctaaaactggattctggtggtaagcttacgacaactctttgaattgtacttcaaatgggtggattttatggtatgtaaattatacctcaataaagttgttttctaaagaaagtctcaatggtaagaaaacgaacaattttttaaatgagcaaaagagttaaacagactcttcaccaaagaggtatacagaagacaaaaaaaaaaaaaaaagcacgtggaagatgttcaaatcactagccatcagggacacgcaaattaaaaccagggtggaatccagttgctgaacaactggatctctcatactttggtgggattgcaaaatggtatagccactccagaaaacagtttgacagtttctttctctttcttttgttcttttttttttttgacagagtctcgctctgtcacccaggctggagtgcagtggcacgatctcggctcactgcaacctctgcctcccaggttcaagcaattctcctgcctcaacctcccgagtagctgggattacaggtacacactaccacacctggctaatttttgtatttttagtagagacagggttttaccatattggccaagctggtcttgaactcctgaccttaggtgatctgccgccttggcctcccaaagtgttggggttacaggtgtgagccaccatgcccggcctcaacagtttcatataaagttaaatatacacttaccatataacctagcaatcaccctcctgagtgtttaaataaatgaaaacttttattcatacacaatcctatatgtgaatctttatattagctctattcataattgccaaaaactggaaacagcctaaatgtgcgtcaacatcataccactgaacactcctcagcaatacgaaaaaaacccaacttgattgaatctcgaaggcactatgctgaattaaagaagccagtctccaaaggtcactactgtatgattccatttaaatggcattcttgaaaagacccgactgtagtgaaggagaaaagatatgtggttgccaggggctaggagtgcagggagtcaggactctaaaggaatagcaggacggagttgttttgcgtgacagatctttcctgggtcctgattgtgatggtggttataccaatctatacatgtgttaaaattcctagaactatatatttaaaagtcaattttattgtataataatttttaaaacagaattttttagaacatcctcctccattccacaaatattttgagtgcctactacatgccaggcactgtgcaaaaggcagtatgtgcgaggagtgaatcagagcatccgtgtgggagacagacctgaacccagccatgagagagaagtggaaagtgaccagcaccgcagtcatggaggagcaggtcatgcctttcagatgggggaactagggatggctgctcagaggaggggcatctggacttgaaggaggggtaggagccattcattcattcaacaaacatttattgagcacctactgtgtgccaagctctgtcctaggccctggggatactaccacgaatgtgaaggagcaggtccctgttctcatggagctcacactctagtgggtgagctgtggatgacatacatgccaccagataagagcgacaggtacacaggagtgctcgaggaaggaggcagggtaacgtgactgtagggaggctgctttagaatgattgggtggttagggaaggcctctcagaggaggtgacattggagcaaagaatggattggagccatgccctgactgatgtggctgtggaaagagcttgggaagccctgggggaagaggaagaaggttcaggtagaagatagggaaggccaggcatagtggctcacacttgtaatcctagcactttgggaggccgaggcaggtgggtcatttgaggtcaggagttcgaaatcagcctggccaacaaaaatacaaaaattagctgggcacggtggcggctttctgtaatcccagctacttgggaggttgaggcaggagaatcacttgagcctgggcgatatagcaagactccgtttaaaagaaaaaaaaaaagatgatgatatggcaaatgccaagcctctgagctgggaagaatctagaagtgtgtgaggaactggacaaggggaagtggagagagatggtgatggagaggcaggccggcaccatgcctgaagcatagtaggtgctgctacgaagtcatctttatccccattgcccggtgcagggaaggaagacaggccagaattgaactgtctgaagctccctcctactggggcttcctgggatccctccaaggcattcagagaggacagcccaggcccccatccttgcctgttccacggctgtggctggtttgatggggttgatggccaatgctcacatatttacttagggcctcatcagccacaacccagaaagaagcagcaaagtgcccacccggccactcacatcctctcaccccacaacccagggggccctcagtcacgctgggcagcgtagggcccctcagaagctgcatgggtctggaagaggggcggtaggaagagccccacagtgcccaggacgcacacaaacatgaacacccacaggaacagccggtccaccaccatagccacgtacttccagtcctcaacgacctgcaggcagacagaggagttggtcacaggtgccaagtactggggtccctcctttccccgagtcaggcccttactctctggccagggactccacaggccacaggcgtggaactgcatactaggggggcaagttctgagtcccaggctggcctcccagctgggcagctctgagcctctctggctgttctccacctccacccctgcctgtcccccacagcgttggaggggcactgggaacttgggctgtacagaaaagctaggaatgtgagggcttgttaatactacatattatgatttgaaaacaaaatctggttatacataggagatagggcctgaggatctcaaagccccaacttctcatttttaccccaaactcactgcctgagctggttctagctaaagaaagaactaggtggctcccacctagttcagtgagagcagagaaaccggggcttacagaacacctggaaatcctgctgtttaatttgttcaagtctgttcacagcagtgtctgtttcctgtaattaagacccagcctcctcctgctgcatcattcaggtctctctggtcttcttagatcctgctgcggggtgtgaggttggcagagacctggctggcctccagaggggccaccagagatgggcctgtctcctttgcactgggggagaacctagagaaacgcctgtgtgcccagggtcctggcctccctcgccgatgcctgctttcacacccctaggcctggctggctcacactgcattcattccctggcagagacgggctggatcagaaggcttcggagatcagcagaggctctggagttggaaatgtgggcagcaacgggcatgctgacgtcagtgacccagtttgtcaaggccctgtcaatggtgtacctaacgtgcaggctaatcctgtgtcaagccaaccccgacacctgcaaccaagcacgcctgcacctgtccccaagactcagcaggcacacacagctctctccacagagcactccttggctttcctgggtttctttttaacagccctaatttcaagcgggggtgtgtgtgtgtgtgtgtgtgtgtgtgtgtgtgtgtgtgtgtgtttcccccttttaatatttttgtgctatttatagtgaccagttaatcagggtgggtaaaagtactgaagatgagaagcggcgtgggctggcttaggggcaggcatgctctagaagggaagaaagcctcttttctccaaccatccataagaaagtcaatcaaccaataagccggccatgtgctcagtgcagggcaagaaactaggaagggcaagaaagtttaaggatgacaggcagatctgggtacagagcctgggccagctgtttgacactggccaagtcagtgaacctctctgagcttcgctttgaaagcctccttattgtaaatgggggttctactaaaagccacttcacaggattccagggagggttagcagtaatgtatgtcagctcccagcagagcacctgatgtgtgattggagcttaatgaacactggtgattataataactggtcctgcctggctccttcccttaagaggcttgtaattaattgagctagaaagagcagaaggcacgtgagtgccaagggggtggtgaggtcttcagaagagttcagggtgggtgccggctcagccagggatgcaggagaccagtacttctcaatctagaatgtgcacacgaaccaccagggattggttaaaaatgcaggctccaatatgtctccgccagagatcctggctcagtcagaaagggtggtcccacagtgttgcccacgtggttctcacttagccagcagggccccaggctgcacattaatgattgggaaccaatgaattaggtgatgctgacctacagaatgatttaacctaagtaatagcgtgatcgaattaacgttttagaaagtgaaatctgagagtcctatagagctgtgcttctcaaactgcaatgggtctgggaatctcctggggacctggttaaaatgcaggtttggagctagcaggtctggattggggcctgagactctgcatttccgataagctcgcaggcgatgccggtgctgctggtccaagaactacaccagaagaatatctcatgtcctatattccatttgtttgcatttctcttcttttcttggcacagtgtgattctggggctgttcctgctcttttctctgtgggctaactaatggaatgccagcgcttctccttgagaatgcagcgagtggaaagcaatctcaaaacggtaagaatgagacgtccacttttgtccatgcagctgcacaggggcagacaccatgttgcatagtaaaaacctgtccaaagaatctgatctgaaggtgttaatatgagaacattcacaagagcatgaaacttgctctccctcctggtatggaaatgggtgtgaaaatttgtcaccaccacattctgtgttgttactatgacattgtccttagaagtgttatttattcaaaggagtcatgtgaaatacccagactccagcactcattgctttatcctgtgaaagtaaattaaacctctttttaaaaaatccgtaattctaggtcaggttcggtggctcaagcctgtaatcccagcactgtgggaggctgaggtgggcagatcacctgaagtcaggagctcaagaccagcctggccaacatggtgaaaccccgtctctattaaaaatacaaaaattagccaggtgtggtggcaggcacctgtaattccagctacttgggaggctgaggcagaagagtcacttgaacctgggagatggaggttgcagtgagccgagattgtgccaccacactccagcctgggcgacaagagcaaaactccatctcaaataaataaataaaataaaaatctgtaattctagttagcacaatcgattaattcattaccctggtaatcatagtatttttactgatgttcctatagccctggaagctataagtgcttgaatggcttctttgcaagtctgaacagaatagggcagatgcgcttggtaccccagcccgcctgtgttccctaaagcctgcagagtcacttcccagccttccatttctggcacccgcatttcctctctcctctgcctcagggctttctccagcaccaagggtgcttgttctggcaggctggcattacctggaagcacaggagagttaaagtcctggggctaccctcatcctttagggaatgggggctggtgggtaaatacctcagcctccttccaggggggtgatcctgaggcttgttcccacgggtctgcaagggtactgagtcccgggtacccacggcagtatcctgctcattcattctcctttccctgtctcactttccctccttcctcactgtgcttcccaggatcacatctcaagtaaaccacctgcacccaagtccccatcttggcgtttgcttctgggacacctaaaacaaacaaactaaatcactggcacgtccttcctctccccggatgcatgaagctataatatttaacacaaactcatttcaattttggattccttattcagagtttgagagtccttgtctcctatgaattaactgcaggaagtgggaagctggtgctactatctgagccctttctgttgggcaggtgggcaggggctggttagcaacttacactctggtcttcatcgtcattcttcatgtgctgggcgatgaagctgacaccttctaatgcctcctgcacatcctgtcggaacctcccagaggaccgcagccagaaatccctggggatagccaccggggtagagccggctggagacttggaagctgcagaggcggggttcacaaagtacatggagttcccatagaagttggaggggctggtggaggtggcggtggcctcgggcttggtcacgcatgacttgctgggcgggaaggctctggccgggctgctgtcggggccagggcgcttcatgaagaggaaggtaggcagcttgtgcaggaagcagcgcttgacccagggtgccatggtgtgggtgctgggcgagcggtggtgcacattgagcacacagacgctggtgacgatggagaaggtgaccagcaccatggtgaacatgaggtacttgccgatgagaggcacatcgagggaggtgggtggcacgatcttggagatgagcagcaggaagaatgtcagtgccagcagcactgagatgcacagtgtcatcttctcgccgcagtcggatggcaggtagaagacgaggatggccagcaaggtggtgagcacgcaggggatgatgaggttgatggtgtagaacagaggcttgcgcttgatgatgaagtcgtaagtcacgtccacgtagctggggtcttgtgggttcactgtccttctccctgggagggccactatgtcccactcaccactgggagtaaagtcatccatgctggctgtgggcgtcatgaggaccatgtctatctccgtgtggtcataggtccaggagcggaacttgagggtgcagttctgctggtcgaagggaaagtacttcacctcaatcttgcaggcgctcttgtagatggcagggggcagccacaggacgctgccgttggaccggactatcaagttggtgtagacagacacctcataggtcccgtcggcgctgggcagggtcagggcatggagaacatcgtgaaacccatacacaaaacctggcctgttctcagaactcactgaagagccctttgggattatttcccactaatcacccttccaatcccccaggccctcactgaaaggaggggtctgcttttgttagcaactatgtggtggagagagccctaacatcaaagcaccccccttttttttttttttgagacagactcttgctctgttgcccaggctgagtgcaatggtgcaatctcggctcactgcaacctctgcctcccaggttcaagcagttctcctgtctcggcctcccaagtagctgggattacaggcatgcgccaccacgcccggctaattttgtatttttagtagagacggggtttctccatgttgatcgggctggtctcgaactcctgatctcaggtgatccacccgcctcggcctcccaaagtgctgggattacaggtgtgagccaccacacccggcccatcaagcactcttaaggcttcccatggaatagctcatttaagcctctcagtagtccagtgaggcaggttttattattatccccattctacagatgggaaagccaaagcccaaagaggttaagtgacttcttcaaggtcagaaaacttgtaagcaggacagctgagatttgaactcaggtctgtctgtccccagaccacacactttgagccatttcaagctactgctggtgtaatcacgactcaggaaaagtctctttggcttcctccacctgcctaagatatttacacacagtaagtcagtggtaccaacaccaacactggcaaagcaacagaggctcaaaaggatagtatggaacacagaaagggtgctgggttcaaggtcaggacactgctgtggtcccagctctgcttcagtgaatcagacaaggtccctcccctccctcagcctccaactccccatctgtaactgagggctctggctctgctcacctctgtttctcttctagcttgatggcctggaaggctgggtaaagcagagatgg

SEQ ID NO: 252 - DNA, 36952 bp, Homo sapiens
cagttcccttaagagcatttgaaccatgtgattcctacgacaattcagtgcaagaagaaaaaaatctgcaagcctgttgagtttatattgtgtcccagttctttgatgaccagtttacaaatacaaattacatacaagaaacatttataagtgctgtgtttccttgggaaaacagtaaataaaacatggactgtctttagagtgagtaaagacccacttttgtttttgccagagaccagaaagtgggattcagtataaaacatagcttctctagtcctgacactaactgtaaaatcaatactactaataagaaaacattattttgtactaatatggcataaaaacctagaagtattcttagcattaaaatcagaatagactaattctacatcaactgttttgctgaaaatgtttaaatgtaaatgtaaaaggtttaaatattcaaacattttaactctaaaatgcaggtacaaaaatgatattcttcaatacccagagaactaactagcatattgcaaaatatcaactaaaatttatgtcagtccaatgaaagagcttaaatgtgggaagtatcagttttgtgtggacttagagaaaagggaggggttttggaggtgctatgatgagcaggacctgtctggcagaggaagaacctttgcaagagagaaagaggagaggcctcccaaaactggcgggaagatgcacattccggatccataggagactggaagtggcccactgtgaaggactggctcgagagcagcttctctcgatggcaggagccagggaagtctttttagtcctggactcacccttctcaactacgacctggatgcagccacccagacgggctgggagcacggggcccagaatgctcatcctactctgtacatgggaaccttgcttcacatacttggggggctatcaatcctttctccaaggcccagaccttttcccagtgggaggaggcctgcagggtacaccgtgtagcagggtaactgtctgatggcaggtttgctgttgggagagtagagaagaggtttggggacacaggcagagacaggctggggtgcccagctcagccccctgatcacagcatcggcctcctgcatccactgcccacagtggccccaaagccacagtggatggctgagaccaccccagacctggctgtgccacacatccactctgggcctcagtcctcatctgtgaaatgtcagggaagggccagatcagggatccccaaagcaagctggtcacacagcccccaggacagctttgtgaaaacacccattcctaggcctacccagacccactgactcagtgtttctgtggggcaggacctggggacaggtatagagattttttggataacgtaatacatattaactttagaaaagacagtgaggaacaaagaataaaatattttgaattcaggcacctgtattttttttttttttttttttttgagacggagtctcactgtcacccaggctggagtacagtggtgtgatctaggtcactgcagcctctacctaccaggttcaagcgattctcctgcctcagcctctggagtagctgggattacaggcacacgccaccatgcctggctaattttttgtatttttagtagagatggggttttggtatattggccaggctggtctcgaactcctggcctccagtgatcctcctgcctcggcctcccaaagtgctgggattacaggcatcagccaccatgcctggccaaacacctgtatttttaaaaagctcattggggctgggcatggtggctcatgctgtaatcccagcactttgggaggccaaggcagacagattgcttgaggtcaggagttcaaaaccagcctggccaacatggcaaaaccccatctctactgaaaaatacaaaattagccaggtgtggcagcacgtgcctgtaatcccagctacttgggaggctgaggcaggaggatttcttgaacccaggaggtggaggttgctgtgagccgagatcccaccactgcactccagcctgggtgacagtaagactcagtcttcccccccccacccccccaaaaaaaaagctccttggtaaccatgccagtcagcaggctgggaaccctgggactacacagcttaggcccacccagctatgatcttctccaacaccctcattctctttcaaagacaaggtgaggagggaccgtttactccattcctgtctgtttgcacagagctgctaacagatgctacattccaggtgccccgggcatctgagccttccccctccacacactggggttggtccttggcccatggatctttccagccttatgtcccacagtccagccaatgaggtcaccttggctgcccatgacatactctcctgcctccccgggccctcctctgctccatctccctgtcctgagatcctacacaatcttcaggattcacttcaaatgccaattcttccttgaaactttcccaatgccatcttccacccacccatgcctgctttgaagccactcagcacactgctgctctctgtggctctccaacatctctggtacctggtatgtagtagttgctgattacatacctatggactgaacaaatgaatgcagccttcttggaaaaggccaaggaaggccaggttttaagcacagtgggccaaaaacccagagcccaggctgacagccctgagagggcgtgggccccccagcaccttacttgttatacagcacaatgtctggcttccagatcttctgtgcagggacacgcatgaactctgccccaccatagtcagaggggttccatttcagcttgtagtcattccagatctcggggaaggaagcagggagggagaaggagacggtaaaagaatcagcctggttttacttcccgtggcaccacccatcttggtgactccccacccctgctgcatgtgaccgaaccacatccatgccatgatcacatagtccaacttctcctgtgggtgtagtgcaggagagagcacacggctggctctgcgggccacctcctggcactagggaagccactgcccccataaccatgagcaagcccagcccctcatcaaccaaacagggcctactcgtgctttctctggtcacttctagtgccaggtggagactcctggacttcatgcatcatgtccaggtccatgtgcctgtttacagcccctgaatggctctccaggggtgttttccaacatagacactctttcaccccaaggttaagcaagactggactctgaaagattccgggggaagaatccatgacccctgcagggcccaggaagtgtctgggtccagaggctgggaggtctgagtcctgagcaccagaggagagaggggtgaggctgcggccacagagggaacgtgtgcatcaagtactgggtggggcactgtgcccatctggctttccaacctcctggggatgaaggctgtgtgtgctgagtgctcagctggccaggctggcagaagggtcacccgcaggccaatgggccattatgtctcctggcaagtctggacaaagcctccctggggaggacatgtggaaggcaatttcttggcctcgatctgaacaggaaaatctactcccacgctaccaacaacagcagcatcttattctgacttaagaatgagtataggggctgtgcacagtggcttctgcctgtaaccccagcactttgggaggctgaggtgtgtggtttgcttgagatcaggcgttcgagaccagcctgggcaacatggcgaaaccctgtctctataacaaatccaaaaattagccagacgtggtggtgcacagctgtggtcccagctacttgggaggctgaggcaggagaactgcttgaaccctgctggtggagattgcagtgagccgagatcacgccacagcactccggcctgggtgacagagcgagatcccgtctggaaaaaaaactgagtttttagcaagagggagagaaggaggtgtctcaggcaccaccccagggtttgggggcagggcttcaatctcaggttcgtactcttctgttgtgtgaacatggagaatgtctttctccaggctgcaacctgtccatctgggacttgaggggttgggccctacagtccttccagggggactgtagggcagtgcatgtgacctcaagccttagaagagatatatctgccagtcagtggaccccaatctgggttccacagaagtaaatgaagcctggtctttaggcctttcttggttcacctaaagcaaataaaacagtcaccaccagggggcagcagtgcctagggtctggtcacttacttgcttgagccacaggttggtctccatgatctggtttacttcatcctagaaagaggaattaaagttgacaggagaattacaaaacaagactaattctgggaaaggctcctccagaagccccggtccccatggccacggctcgtggcttccagcactcaccaccttcaccagctgagacatggacacctcgaaatggatgatgactgggtcagacacgttggctacaggccggatgatctcattgtaatcttcaaacagccgctcaaatagacggtgctcagcctctgaggccctggccactgtgggaagcagccctgtcagtccctggggaaatcgttacttaacctcccccacccagcccagcagaaacatcacccatctacagcatcccctccacctgtggggggattctgtggaaccctagactttcaggccagtctaacccagtgggttacaaaatgggaaactgaggcccaagaggggcaggattctacctggccacacgcattcagtgagaagcacagtggttgcaagcctgggctctggagttggacagatctggtgcaaatcctgacaaatcacttgtaagctgtgtgagcttaggcaagtggcttaacctctctgaacctgtgtctttaccagtcaaaataaggattataaacgtatccacctcaaagggttgttgtgaaggaagtgcacagcttggtgctgcggtaagaggtcaagaactattcgcaatcttttcctgggttgtttctgccgggtgggggtgtggggcaaatgctgtctgcctgggtacagccactcactgcttccacgatggaaagatggccagtccgctcccaggggcagggccaaccacggtcgcccaggcccaggtcttctacctcccagcctccgggagaacacagcccaggtctgggcctctcctgcattccaccctgtaggggtggccaccagccctcttagaagccaaggcactgtgtgactcccgtgatctcgtgtgacccccagctcttgctgatgctgtcttcatatcctgatgaaagactctgacctctgcaacccttgggcacccctctttgttcctaagccacaccccagcacaagtgaggcataccgggtcagctgtcttctgattcccacgtacagatctgggggcagcttggggaagcgggaggagaatcctctaggaagttgaatccaacttcctcaggtcttgaaataggatttttcctgctccccactctccttccccaggatgaaagaagggtcccaggcaggaggtcggttgagagcgtatggcgttctgagtagtgcaggcctcggcaccgagggcggaaagcgctctgagctcacagccgcacgacagaccgccggcctgggccctccaggaattccctgcagccttgcccggtccccgactctcgctacccaccagccctcccaggcacccaagagcctcccagcggcgggccagggccggcttcccccagcaggctcctctggagagcgggaggaagacaggaggcgctctcccggtggagggtccctcagcgacgcagccaggagcgctaggaggctacaaccggaggagaggctggcgctccagctccagccccagtcccgaagcgactcccctcttcccgaggtggccttggccaagtcttcagccatctccgtcaaatgaggaggtgggcgggatgcagacggtggagcgggaggcttgggcgcgccagtttgggagccagtgcgcggggcagggcgacgggcagcgcggggacgcgaatccccaactcctgcgcccaagacgaaggacccggtctcgacctccccatcacccggcgcgtaccagcgcccgctcagtgactcccaggtttggtggtggctaggggtgggaggtgagccgaaagggaaaaagccaccccacccaagtcgccgccgggctggagccagtctgcgcgggttccgagtccccggcgacggcgccagccctctccgctcgcccgcgcggtgttctcgccggcagcccctccggaccccgcgccccttctcgggcgcccgtccctccggagccctaacgcctgtgcgcgtacctggcagcagagacagcagcagcagcagcagcagccgcggcggcgacagcgccaggggcagcgagagcgggccagagcccatggctggtggccgggctggccgcggacccggacggtcgggagcgggcgcggcggtcgcagagacggcctctccccgcgcggctccagcgcagaccccagacctggagccgtgcgggcggagacgcgcggggctcctctccgcttcgccgccgctgggtttccagcgccctcggacccgcgggaggacaggaaccatccggagtgaagctgcgccaggcgcgggcgggcgggcgggcgtgcgcggggcggggcgtacgtgcggtaggggaaggggctccaggtcccagtccccagcgccgggcgagctccttctccgccgggctgggtgctccggccggcggcgtccgaccagatctgagcaggtgctgtcaccaccaccaggaaggagagggactcagtttctgtcccaggtttccggggcgtgtgcagctcccgcagggggttgggaccaccgggctaggcgggcgccgtaggagagacgctaacacaccctgggaaggacgccttgtgtatctcatgctattaaataattgttaaatattttagccgggagcagtggctcacgcctgtaatcccagccagcactttgggaggccaaggcgggcggatcacgaggtcagagaccatcctggctaacatggtgaaacctcgtctctactaaaaatactctacaaattagcccggcgtggtggcaggcacctgtagtcccagctactcgggaggctgaggcaggagaatggcgtgaacccgggaggcagagcctgcagtgagccgagattgcgccactgcactccagcctgggtgacagagtgagacttcatctcaaaacaaaacaaaacaaaacaaaaaaacttagatatagtactggtattttttttttaagtccttatagcttaggggtgggtggaagttagttgaaacaatattggctatgagttgataattgtcgaggcaggatgatggtacctggaggtttgttatactgttctcttaactttggaatacgtttggattgttccttaatgaaaaattttttggggtgatcagacccaaccccaggccatgggggtgacaaagtcaggcggagtcaaaagaatgagaaaagacaagagagaaagcgggaccaggcggccaacgtatggaggctacgaaggcccccagctgtgggagcccacgctatttattggtgatcaaagaaacaggtggtgaggatgtgggggttgaaaggaagcggtgtatcaagcaaatgaactacagctgtgacggtagttcacctcccatcccaaagtgctgggattacaggcgtgagccactgtgtgcagcctcatctgctcttctgatggagcaatctgagagggcaatggggttcccaccctagtcccctgcagaacctgtccccttccccgccaccatctgcaaccccaagaatgtgcactgattggccaggcagggtgccctggagcctcctgccctctctgaccacccaccagggatggggggcaccttgatgttggcttctttgacatccttttattgcaggaggaagttctgtcataaactctcctcctggcattcagcaaatggagagtcacctttatcatttccagaatgtgctgtttacccatattaaaaccaaacaaaaggagacagtttgtggaatggaaaatgtaagaattgggacccacctctcaggcctccaattacagcattctcaactcttggcaaatgtcccccattgggacaatactgtaagttatatatccaacaaaggacttgtatccagaatgtataaggaactctcaaaactcaacactaagtgtagatgcatatgaggggtcttactggggtgatgcagatgttctaaaactggattctggtggtaagcttacgacaactctttgaattgtacttcaaatgggtggattttatggtatgtaaattatacctcaataaagttgttttctaaagaaagtctcaatggtaagaaaacgaacaattttttaaatgagcaaaagagttaaacagactcttcaccaaagaggtatacagaagacaaaaaaaaaaaaaaaagcacgtggaagatgttcaaatcactagccatcagggacacgcaaattaaaaccagggtggaatccagttgctgaacaactggatctctcatactttggtgggattgcaaaatggtatagccactccagaaaacagtttgacagtttctttctctttcttttgttcttttttttttttgacagagtctcgctctgtcacccaggctggagtgcagtggcacgatctcggctcactgcaacctctgcctcccaggttcaagcaattctcctgcctcaacctcccgagtagctgggattacaggtacacactaccacacctggctaatttttgtatttttagtagagacagggttttaccatattggccaagctggtcttgaactcctgaccttaggtgatctgccgccttggcctcccaaagtgttggggttacaggtgtgagccaccatgcccggcctcaacagtttcatataaagttaaatatacacttaccatataacctagcaatcaccctcctgagtgtttaaataaatgaaaacttttattcatacacaatcctatatgtgaatctttatattagctctattcataattgccaaaaactggaaacagcctaaatgtgcgtcaacatcataccactgaacactcctcagcaatacgaaaaaaacccaacttgattgaatctcgaaggcactatgctgaattaaagaagccagtctccaaaggtcactactgtatgattccatttaaatggcattcttgaaaagacccgactgtagtgaaggagaaaagatatgtggttgccaggggctaggagtgcagggagtcaggactctaaaggaatagcaggacggagttgttttgcgtgacagatctttcctgggtcctgattgtgatggtggttataccaatctatacatgtgttaaaattcctagaactatatatttaaaagtcaattttattgtataataatttttaaaacagaattttttagaacatcctcctccattccacaaatattttgagtgcctactacatgccaggcactgtgcaaaaggcagtatgtgcgaggagtgaatcagagcatccgtgtgggagacagacctgaacccagccatgagagagaagtggaaagtgaccagcaccgcagtcatggaggagcaggtcatgcctttcagatgggggaactagggatggctgctcagaggaggggcatctggacttgaaggaggggtaggagccattcattcattcaacaaacatttattgagcacctactgtgtgccaagctctgtcctaggccctggggatactaccacgaatgtgaaggagcaggtccctgttctcatggagctcacactctagtgggtgagctgtggatgacatacatgccaccagataagagcgacaggtacacaggagtgctcgaggaaggaggcagggtaacgtgactgtagggaggctgctttagaatgattgggtggttagggaaggcctctcagaggaggtgacattggagcaaagaatggattggagccatgccctgactgatgtggctgtggaaagagcttgggaagccctgggggaagaggaagaaggttcaggtagaagatagggaaggccaggcatagtggctcacacttgtaatcctagcactttgggaggccgaggcaggtgggtcatttgaggtcaggagttcgaaatcagcctggccaacaaaaatacaaaaattagctgggcacggtggcggctttctgtaatcccagctacttgggaggttgaggcaggagaatcacttgagcctgggcgatatagcaagactccgtttaaaagaaaaaaaaaaagatgatgatatggcaaatgccaagcctctgagctgggaagaatctagaagtgtgtgaggaactggacaaggggaagtggagagagatggtgatggagaggcaggccggcaccatgcctgaagcatagtaggtgctgctacgaagtcatctttatccccattgcccggtgcagggaaggaagacaggccagaattgaactgtctgaagctccctcctactggggcttcctgggatccctccaaggcattcagagaggacagcccaggcccccatccttgcctgttccacggctgtggctggtttgatggggttgatggccaatgctcacatatttacttagggcctcatcagccacaacccagaaagaagcagcaaagtgcccacccggccactcacatcctctcaccccacaacccagggggccctcagtcacgctgggcagcgtagggcccctcagaagctgcatgggtctggaagaggggcggtaggaagagccccacagtgcccaggacgcacacaaacatgaacacccacaggaacagccggtccaccaccatagccacgtacttccagtcctcaacgacctgcaggcagacagaggagttggtcacaggtgccaagtactggggtccctcctttccccgagtcaggcccttactctctggccagggactccacaggccacaggcgtggaactgcatactaggggggcaagttctgagtcccaggctggcctcccagctgggcagctctgagcctctctggctgttctccacctccacccctgcctgtcccccacagcgttggaggggcactgggaacttgggctgtacagaaaagctaggaatgtgagggcttgttaatactacatattatgatttgaaaacaaaatctggttatacataggagatagggcctgaggatctcaaagccccaacttctcatttttaccccaaactcactgcctgagctggttctagctaaagaaagaactaggtggctcccacctagttcagtgagagcagagaaaccggggcttacagaacacctggaaatcctgctgtttaatttgttcaagtctgttcacagcagtgtctgtttcctgtaattaagacccagcctcctcctgctgcatcattcaggtctctctggtcttcttagatcctgctgcggggtgtgaggttggcagagacctggctggcctccagaggggccaccagagatgggcctgtctcctttgcactgggggagaacctagagaaacgcctgtgtgcccagggtcctggcctccctcgccgatgcctgctttcacacccctaggcctggctggctcacactgcattcattccctggcagagacgggctggatcagaaggcttcggagatcagcagaggctctggagttggaaatgtgggcagcaacgggcatgctgacgtcagtgacccagtttgtcaaggccctgtcaatggtgtacctaacgtgcaggctaatcctgtgtcaagccaaccccgacacctgcaaccaagcacgcctgcacctgtccccaagactcagcaggcacacacagctctctccacagagcactccttggctttcctgggtttctttttaacagccctaatttcaagcgggggtgtgtgtgtgtgtgtgtgtgtgtgtgtgtgtgtgtgtgtgtgtttcccccttttaatatttttgtgctatttatagtgaccagttaatcagggtgggtaaaagtactgaagatgagaagcggcgtgggctggcttaggggcaggcatgctctagaagggaagaaagcctcttttctccaaccatccataagaaagtcaatcaaccaataagccggccatgtgctcagtgcagggcaagaaactaggaagggcaagaaagtttaaggatgacaggcagatctgggtacagagcctgggccagctgtttgacactggccaagtcagtgaacctctctgagcttcgctttgaaagcctccttattgtaaatgggggttctactaaaagccacttcacaggattccagggagggttagcagtaatgtatgtcagctcccagcagagcacctgatgtgtgattggagcttaatgaacactggtgattataataactggtcctgcctggctccttcccttaagaggcttgtaattaattgagctagaaagagcagaaggcacgtgagtgccaagggggtggtgaggtcttcagaagagttcagggtgggtgccggctcagccagggatgcaggagaccagtacttctcaatctagaatgtgcacacgaaccaccagggattggttaaaaatgcaggctccaatatgtctccgccagagatcctggctcagtcagaaagggtggtcccacagtgttgcccacgtggttctcacttagccagcagggccccaggctgcacattaatgattgggaaccaatgaattaggtgatgctgacctacagaatgatttaacctaagtaatagcgtgatcgaattaacgttttagaaagtgaaatctgagagtcctatagagctgtgcttctcaaactgcaatgggtctgggaatctcctggggacctggttaaaatgcaggtttggagctagcaggtctggattggggcctgagactctgcatttccgataagctcgcaggcgatgccggtgctgctggtccaagaactacaccagaagaatatctcatgtcctatattccatttgtttgcatttctcttcttttcttggcacagtgtgattctggggctgttcctgctcttttctctgtgggctaactaatggaatgccagcgcttctccttgagaatgcagcgagtggaaagcaatctcaaaacggtaagaatgagacgtccacttttgtccatgcagctgcacaggggcagacaccatgttgcatagtaaaaacctgtccaaagaatctgatctgaaggtgttaatatgagaacattcacaagagcatgaaacttgctctccctcctggtatggaaatgggtgtgaaaatttgtcaccaccacattctgtgttgttactatgacattgtccttagaagtgttatttattcaaaggagtcatgtgaaatacccagactccagcactcattgctttatcctgtgaaagtaaattaaacctctttttaaaaaatccgtaattctaggtcaggttcggtggctcaagcctgtaatcccagcactgtgggaggctgaggtgggcagatcacctgaagtcaggagctcaagaccagcctggccaacatggtgaaaccccgtctctattaaaaatacaaaaattagccaggtgtggtggcaggcacctgtaattccagctacttgggaggctgaggcagaagagtcacttgaacctgggagatggaggttgcagtgagccgagattgtgccaccacactccagcctgggcgacaagagcaaaactccatctcaaataaataaataaaataaaaatctgtaattctagttagcacaatcgattaattcattaccctggtaatcatagtatttttactgatgttcctatagccctggaagctataagtgcttgaatggcttctttgcaagtctgaacagaatagggcagatgcgcttggtaccccagcccgcctgtgttccctaaagcctgcagagtcacttcccagccttccatttctggcacccgcatttcctctctcctctgcctcagggctttctccagcaccaagggtgcttgttctggcaggctggcattacctggaagcacaggagagttaaagtcctggggctaccctcatcctttagggaatgggggctggtgggtaaatacctcagcctccttccaggggggtgatcctgaggcttgttcccacgggtctgcaagggtactgagtcccgggtacccacggcagtatcctgctcattcattctcctttccctgtctcactttccctccttcctcactgtgcttcccaggatcacatctcaagtaaaccacctgcacccaagtccccatcttggcgtttgcttctgggacacctaaaacaaacaaactaaatcactggcacgtccttcctctccccggatgcatgaagctataatatttaacacaaactcatttcaattttggattccttattcagagtttgagagtccttgtctcctatgaattaactgcaggaagtgggaagctggtgctactatctgagccctttctgttgggcaggtgggcaggggctggttagcaacttacactctggtcttcatcgtcattcttcatgtgctgggcgatgaagctgacaccttctaatgcctcctgcacatcctgtcggaacctcccagaggaccgcagccagaaatccctggggatagccaccggggtagagccggctggagacttggaagctgcagaggcggggttcacaaagtacatggagttcccatagaagttggaggggctggtggaggtggcggtggcctcgggcttggtcacgcatgacttgctgggcgggaaggctctggccgggctgctgtcggggccagggcgcttcatgaagaggaaggtaggcagcttgtgcaggaagcagcgcttgacccagggtgccatggtgtgggtgctgggcgagcggtggtgcacattgagcacacagacgctggtgacgatggagaaggtgaccagcaccatggtgaacatgaggtacttgccgatgagaggcacatcgagggaggtgggtggcacgatcttggagatgagcagcaggaagaatgtcagtgccagcagcactgagatgcacagtgtcatcttctcgccgcagtcggatggcaggtagaagacgaggatggccagcaaggtggtgagcacgcaggggatgatgaggttgatggtgtagaacagaggcttgcgcttgatgatgaagtcgtaagtcacgtccacgtagctggggtcttgtgggttcactgtccttctccctgggagggccactatgtcccactcaccactgggagtaaagtcatccatgctggctgtgggcgtcatgaggaccatgtctatctccgtgtggtcataggtccaggagcggaacttgagggtgcagttctgctggtcgaagggaaagtacttcacctcaatcttgcaggcgctcttgtagatggcagggggcagccacaggacgctgccgttggaccggactatcaagttggtgtagacagacacctcataggtcccgtcggcgctgggcagggtcagggcatggagaacatcgtgaaacccatacacaaaacctggcctgttctcagaactcactgaagagccctttgggattatttcccactaatcacccttccaatcccccaggccctcactgaaaggaggggtctgcttttgttagcaactatgtggtggagagagccctaacatcaaagcaccccccttttttttttttttgagacagactcttgctctgttgcccaggctgagtgcaatggtgcaatctcggctcactgcaacctctgcctcccaggttcaagcagttctcctgtctcggcctcccaagtagctgggattacaggcatgcgccaccacgcccggctaattttgtatttttagtagagacggggtttctccatgttgatcgggctggtctcgaactcctgatctcaggtgatccacccgcctcggcctcccaaagtgctgggattacaggtgtgagccaccacacccggcccatcaagcactcttaaggcttcccatggaatagctcatttaagcctctcagtagtccagtgaggcaggttttattattatccccattctacagatgggaaagccaaagcccaaagaggttaagtgacttcttcaaggtcagaaaacttgtaagcaggacagctgagatttgaactcaggtctgtctgtccccagaccacacactttgagccatttcaagctactgctggtgtaatcacgactcaggaaaagtctctttggcttcctccacctgcctaagatatttacacacagtaagtcagtggtaccaacaccaacactggcaaagcaacagaggctcaaaaggatagtatggaacacagaaagggtgctgggttcaaggtcaggacactgctgtggtcccagctctgcttcagtgaatcagacaaggtccctcccctccctcagcctccaactccccatctgtaactgagggctctggctctgctcacctctgtttctcttctagcttgatggcctggaaggctgggtaaagcagagatggggctcagggttggactcaggcctggatgactcttagggctgggcctgctgccctggcctggctgtcaccaggcctccaccaaccctgccactcacttgttgtaaagcacgatgtcaggcaaccagatgcgctttgcagggatcctcaggatgttcacaccctcgtagcgggagctgttccaggtcaggcggtaatcagtccattcctggacagacaggcaaggccctgtcacttgcaggtccactgccaccaaagggcagccctaaagaaaagatctctggggctcagggcccttcagggcacttacctgtttcagccagacattggtggtcatgatctgctctcgctcattctggggagggaaacggggctatcagttcaccaggaaggaggagcctcacaaatggattgcactttattgtgcaaaaggctgtgagctccaggcccacgtgaccaactgccaccccaacatctcttggatggcccaaaggcatgtcacactcagcatgtttgacacaaagctcatgatcttccccagaacctggtcctcctttggcttcattgtctcagtgaatggcacccctagccatccagttccacaagccagaagcgtggacactgtctctgacactttgctctctgatccatcaataagtcttgtaagctatatcttctaaagcaactcatatttgtctgcttctctccaccgccaccatcatctgtcacttagactaccgcaggagccccctaactggtcttcctgctctgtcctggcctgcctttagtctattctctacatggtagccagggtgatccctttacaatctcaatcccttctactaattgttctgctgccacatctcatccaaagtaaaagccaaagttctgcttagagtccacaaggccctagtgatctgcctccccaccacccctcatcccattagctctatgacctcttatctcaacactccgccatttgctcattccacttcccctgcactgcctctttgctcctgcacacactgttcccttttcctggaaaccccctgggatgcttccacactttattctgttatcagaaatgtcatcctatctgagaaatcttccctgacctacataaaatagcacctcggtccctgccctgccttctctttttctttctttctttctgtctttcttttcttttctttctctttctttctttctttctttctttctttctttctttctttctctttctctctctctctctctctctctctctctctctctctctttctttctttctttctttctttctccctttctttcttttctttcgtgtgtgtgtgtgtgtgtatttcttgagacagggtctcactctgtcacccaggctggagggcagtggtgtgatctttgctcactgcaacctccacctcccaggctcaagcgatcctcccacctcaggctcctgagtagctgggactacaggcacaggccaccatacctggctaaattttaaaaaattttttgtggagatggggattcatcatgatgcccaggctggtctcaaattcctgagctaaagtgatccatgcatctcagcctcccaaagtgctggcattacaggtacaagccacctcacccagtctccttatttttttttcgtagcatttctcacccctaaacaccatctatctatctgtgtattgtctgccacctcccactagaatctaatggctatgagaaaataaggcagatagaagagtatgtaacatgttggatactccataaatattttttgaatatacaggaatcctaccataataatccaggccaccataatccatgtctcacctggaccatgtaagaccctcctaactggcctatgttcattctgtacaccaccaccaccgccaccatacacacacatacatctcttcttcgtacgcagcccaaataaaccttccaaagttcctgtcatttcctccctcaattttatccctgtttagattaattccttggcttccttcacctacagaataaaaatcttgctccttcgcagggtctacggggccttgccaggtttcccagcctcacttcacctccctatgtccctctgttctgtcctccagccccctggccttctttagtactttggataagtcttgtgttctcagtctgtacaattttggtgcctctcctttatcaagataacttccagcatactgatctcactttgggagtcatttcctcaaggaacctacaactagataagattatcagtaagataaggtttggctgccagtaacagtgatccagagtaacacaggcttaaataaagtagaaattcatgtccctctcatgttaacactttagacatatatggcagttctgctctacaaagttctgataggtacccagattctttccaactttcttctccaccatacctagagtgtggccctcataagaatggatcaaaataactgttggagctctaaccacaaattccacattccaggctgttggtgggaagggaggagggagaagaagaatgcatggcaatttgtctcattttgattagaatatttaggccatttacatttaatgtagttactgatatatttgggctcaaacttaccccctgagcttccacagcatcagatctgcccccctgcatacccccgatctcttgccaagtggcatttgggtctttatgtcattttcctcacatgtctgggagtaaagacgaggttcagggacttgagcttgtgtactctggtgtcttccaggagaatgtgtcaagtacaggggagatggcttggaaagaggaagactcagaggagagtcaaggacatcaaaacaggcaagcccaggagcaggaaaagagatgagagtcagcagaggaaacagtgctggggcaggggagcaggtggaagggtcagggaataaggggggctggagaggtgggggtggggatgctggcgagggagtgcctggctcaccagactctggagtcaatgacaaaacagctgctttgacaagcctgctttccttacccagccctaaatccctacctgctctctaaaaatttccatctttaaactggttgtacctataaccctccctcctcaaataaataaacaaaccctggcaacccacaacctaatatttactgtatacacaagctttcggaaatataacttgcatgggtgggggctggtggccgcatcccctcctccttctggtagccgctatcaccctatagggccggcagagcagatctgaccaggtagcctgagtctggaagtgcggcagagcctcctgctcgttcaccctcactagggcagcagctgcaccgcagcagctgggttcaactcattaagcaagaagccctgggctggacaataacactcagacaccagcctgagcaagcctggctgaaagccctccttccttctggtccgactacggagggagaggggcagagagtacacagctctccagccctccccatcctggggctgtgcgtcctcccaggagatggagccagtcattaatttggccaaagccttcctgagggctgtaggtttgacaggctgggtgtgtgtgggccaaccgtgctagagagagagtctggcatttcagaaggcagctacctggccagaggagggtcagcccccttggtggtctctttcccctggctggacacagcgccctgcactctccccttgtgaatgttcccccagagcttcttccagggacggagttctaaccctgtggatggggacatgggaaggtttacaataggccatggttccctctgacatctccaactcagaggcagcaaagagaagagaaattcccaggcacctcctccctcagcacccccacctctgccccacatccacatatggacaacctgacaatggtacctgtgaatgctgccatccactcctcctttccatgcctgcagcagccacgcccactgtccatccctcaccagcctggctcaataggtgctgcactgcctctggtcctgcccctacacctgggcctctctgtacctatcagttcccccagtctggtttttacttctcccaacaagtaagaagcatgtaaggttatctgagcagtctaggggagagaatagggtggggctgtaaagacaaggaggagaagcttatggtcatgctggagacccagctgagcagagtctacagcaggcccattggctgcctacccaatggtcatcctgctcctaccctcatttcttctttgttagaacaaaatcatgacttcattaaatattggacacctatgaacttcatggacccttctgcagcctccctgacacgtactggtaagtctaagtcaactatagtagtttcattcctttgaccaatgatcgcctggggcttgggcatgagcggcctctccacctgagcctgagccacagctgccctctgcacctaccacgctgataagctgggccagggagagctgcagcttgatggagatgagctgtgaggagctggtggctgggcggatcaggttattgtaacgggttttgttcagaaggtcgtccatcagcttttcctccgcattggccacgcggcagttccctgagaaaacacacagtcagacctgctgggcccttgtgcacctgacccccactgcagcctgtggcagcagggagagctgagagggagcacaggtgcccttagggctggctgaagcagcgaaggtgctggcaggcctgtctctccttgaggacttcaaattaaatacactcaacacagagctcagctgtctcctcccatgccatacttcttcctcctcctcttccctctagcagtgaatggcatcccactctacatatctggtacaaaagctgggtgtctcttcttgacctctcccttggttcatccaagtggccacttagtcctgtctttttttgtatgagacagagtctcactctgttgcccaggctggagtgcggtggtgtgatctcggctcactgcaacctctgccacctgagttcaagcaattctcctgtctcagcctccagagtagctgggattacaggcctgcgccaccacacccggctaatttttgtattttagtagagacagggtttcaccatattggccaggctgttcttgaactcctggcctcaggtgatccacccacattggccactcaaagtgctgggattacaggtgtgagccaccattcccggtcctagtcctatcttttaccttccaagtccctcagtctgttctccttatctctactgctacagccatgtccccacctccccacccctgccctcctcctggtctctccacccgcagtctctccctgctatccatgtaccatacagtgccagagtggtctttctacagcaaactggtctagggcccttccctacccacaactctcagagctgtaggtggacttaaaaatcaaatgttttggcttggcgttcaaggccctttccccactgacactggcttatctttctcaatctgattttctcccacctctctacctctaccccagatactcagatactctctcttctggccatagcctactgtttgcctttccccctgtgaccttcactgtctcacttcctgttttttcctttttttttttttagagacagggtcttgctatgttgcccaggctggtttcaagtgattcctcctggattcaaaggatcctcccacctcagcctccttagtagctgggactacaggtgtgcaccaccacacccagcttgtctcacttctttgaacagactctttcttctgccaagattgcccccagcccaccagttatgaattatctgagggtctatcttgtgccagggactttactacatttcgagggtaacagcaagcaaaaaccagaaacggttcctgacaccagagcacttacagtgcaggggagcagccccattactcacatgtgagtttgggtgcagaaatgggtacgaggtggtgctttccctaagaagaaacagagctgagatggaggggattttccgggttcagacttagacctacagagtgtaaggtccctctgagacaccaaatggaggggtccagctggcagctggctcctcatctggagcttcgaggagaggtcttagctcagagccatattcaagacccagcctaaataccgcctcatgcagggagcccccctgaccttccatagcctcaaatctgcccctctgcatacccccgatcccttgccaagtggcatttgggtctttatgtcatctccctcacctgtctgggagtaaaggtgaggttcagggacttgggcttgtgtactctagtgtcttcagggagaatgtgtaaagcatagagggggcagcttggaaaaagggagactcagaggagactcaaggacatctgaggaggcaagcctgggaggaggaaaagagatgagaatgagcagaagaaacagtgccggggcagggaagcaggtgggaggatcagggaataagaggggccggagaggtgggggcgggcatgctggtgaggggctgcctggctcgccaggctcaggagtcgattacatcttcctgcaagggccagttcacctagttgcaccaaaccccttcctctgtgggtagggccagaaggcccagagcacagaccaacccaattaggcaggcctgaggtggacttaggggtgggtgctgggctggactcctggttgtggggagcagccgccaccctgccgacttcatccactttccaactcgctgcctatctggaacagatgcaatatttagtgccttgtgaaagatgctcctagtgcacctgctgcctgctgcccctcccccaggctgccctgggctctccagaggggggtcctatggatgcttggcctagattctgagccctgcttcttatatccaggacccctttcccagaggccagctgcttgagtaccctggaagccagtctgtagccccaggctagagctgggtccctcccacagcccttctttagcatgtttgtttggactgacttatttcatagagaggggtgtgtcttgcccaagcccatctggcatgtctgaggcagctctggggtcagaatctgcagctcccatcccccagccctgcaatactaggggaggctggatcccacatctctgaagtcccactaggctggtctgacagggctcccaagcgcagggctgctctgcaggctgtggggctcatgctccagctccgagcccacctgatgtgcccgggtggctcacctttgggcctgtcctgcctctcaggcattcagctgacccggagggactcccccatcttgaccaccagctgtgggcttgagttagaggttcccagaactttagaccatttagcccaaccccctatttctcagctggggaaactgagaccaaagagggaagaaactttctcaagtgcccccagcaagtcagaggaggaaccaggtataggagcctctttccgacagaggtcttccctgacccctgagccttcttcagtgcctcattagcttccctgtaaggagactgccccacagagcctggaaatggtgctgtcccgggcagtgtgtgcccatgactgcgcctgtgtttgtacttgtgagtgtatggccggggggccgggggggtggtgcactgaagggtgggaataaacagcagggatactggggactggaatgcaccccacttgccccccaaaaaggggcgacggagcccagcccagcccagcacatgcttagactttccaatctactgaatgtctgtgaggcctgctgggctcaaaggacaaggaacaggcctttcacccccaggtggcaggggtggcccaggatgggtggaagcttctgcagcacggtcaggggtcacatcccagcccatgggctgacagttaaacagagaagccgccactaggggtcagtcatgattcaatgattctgatgaggagtgggccccaccagcctctgcccagggttttgtcttccaggccttcttgggaagaattgttccctgccagaaaggggctaataatctgagaggaagccatagctggaattctaaactgtgtgagtgtgtgtccagtttggaaaggtatatccaatctaaaaatttgtattgaaaaaatggaaagatatacctattgttttggaatacaaactacagaaagtaacagttaacagaatcttattggaaagattagattctgcatctggaaaggcagagtgatttttcaactggggtgtatgtccttaactgaggaagggaacatgatatttatattaaaaggcagctatgattttcttttttctgagacggagtcttgatctgtcgcccaggctggagtgcagtggcatgatctcagctcactgctgcaacctccacctcccgggttcatgccattctcctacctcagcctcccgagtagctgggactacaggcgcctgctaccacgcccggttaattttttgtatttttagtagagacggggtttcaccacatcagccaggatggtctcgatctcctgacctcgtgatccgcccgcctctgcctcccaaagtgctgggattacaagtgtgagccaccgcgcctggcctatgatttttctttatgtagagaatttatcttttataaagagcttattacatactattagtgcttcttcaatcatgtgtattaatcacctggattcctaggctttattcccagagattctgatcctgtaagcctagggtgggacccagaaatctgtacagggtgatacaggctgccccaggaccacacctaagaaacactgccactggcccccacacacatccaagtctccaaatatgtaggcagggcacattctctccatagaacagatggggaacctgaggtccaggatggtgaaagaaatggcacagggtcacccagctagtagaagagccacgatacacagactgcctgcagacaccatctttgatgagagctccacctctttataggagtagtacaaactactttctgtagtttgtattccaaaatgatgggtatatctttccattttttcaatgtaaatttttagattggatatgctttcccaaactggacacacactcacagtttagaattccagctatggcttcctctcagattattagctccttatatattccctgactcctacctcctgcctcccctatggtgggtctctatccaaggaagaggtagccctggtcctctaggctgactggggcttggaggaaaagcctgggtgactgtaggagctagaagggcccttggaattcaggtggggaaactgaggccctgagaaggcagtcctcacatttgcattctacctggagaagggctgggtctccttcctgagtggcaggcccaacttcaccagcctggccctcagtcaagctggctgtccaggcccggcacacctcgggtgggtgaccagaggcagcggtgccataaaatgtgtttgctgggagatccacccccaaagcacaaaacattccagggctgctgatttgggcaagcccccttccttctcggcccagtgtccccatctctaccaccgctgtgtgggaggggacttctctctaaggctgagcagcagattcgctcccaagcgcctacaccgcccaggtggccggctcctctgcacccacgcttcaagaaagtcacctcttaggcaaggaaggagcctcggccctgttgggagcgggagtcggtatactcccagcctcccagactgctggggatgacccgcggtgcctgcaaagccggtgtcatccagcccactgcccagcccacagacactcgccctggagggtggccctggccctggcagcggctccgagaagaggcggcccccactccaaacctggcagacccacccacgcaggcccgcccccgctgcctcagcgagtgggctcagccctgcccacgcccccatctggccgggacaatctcgggccactcccccgggcgcagggcaccctcccttccctcccacctgtggccagtccagcccctttcagcccaacccaggcgcccctccctccttccccgaaaagaactcaccgcgcccgcaaagggcgaccaggaagaaaaggaccagggaaggcgcgcgcctcatggccggcggggccgggtggcagccgccgcgagctccgctgtggggtcacagggcacccgtgagccgcgcggtcgagtgagcgccggtcctggcccccgaggtttgctggcggggcggcgctcactaggaccccgcggagagccccgccgagccccgcccactcagggatgtactgggcccgctgctccgccccgacgccccctgggtggtctggaccccacctgccgcctggcttccctatctcttcgggcctcgcaaccttcccccaaggaaggcaggcaggacagtgcgggcacccttggtacagctggggagactgagccctcgagggcggcggacgctagcgcaggatccctctactgttggggaaagagcatgtgcttgagcggggaggtccttgggctttgccttccctcacctcgaagacgcttttaggcaaatgagtcatctcaggttcattcgcatggggtttgctgaaagaaaggacactgctgggtgagccgacgcgagggagcgctgctctctgcagactttgcagggaggacacttaggaaaagtgagtggaatctgggagggtgaatagctcagggcccctcacccagcttgggggctggggaaggagcagagttaaaagggaatggggctggagtgggctggcctcgtcctcccccatgggccttccaatctgggctgaacagaggccgctcaggtgattcaagcacatccctctactagccagggtgtccttgacgcgtttttggaatcagtaccattcccttgcgggtggggggacagcccccacctcgggaactgcagcctcaattctggatctagaagggcctctggcagcttctccaactctctcagtccggtcctcatacctgctcccttgtgtgggccctaacaggcaaatctgacaactggaggaacaagacaggaagggcggggtctaagggaaccgcctgtaaaaaggcagctttgccaccttatctccaggactctcagtcttgctttcatattgctccccccacgtcattttgctataatctgacatgttgacatatggtctttaaaagcaacaacaacaacactgttgaagtgaagcggacttcccctttgggatgctttggagaagttaggattgagggcatcctctcttctccaaactgcagcagtaataggtaagatatgtaaagtaaataaagacatggcaaggctggaaaataggataatcatctccatgaaccaaaaccagaaaagaaatgcaaagtggttggaggctgaagagcctggagcctgttgggctttggaaaccaaagacagtggcaggtcctttgggataagcggggaccaaaagactcttggctagaagctgggagcttgggtgtatgccagtacttgaaaggatgctgggagcgggaggcctgctgctgatccgtggtctgtatccctggctttatcggatgtgtacatccccaatatacccaggacaggagcttggaaaggacataaaacctggaggccactgcagagctgtaaaagttaggctagcaaaggggatacgatgaaataggtttttatagagctttgacatgtattttctttaaataaaaagaagagctaattatctattgagaataatataatcttggtacaaaactagaacaaggatgtacaaggaaaacacattatagaacaatctgaattatgggtctttgtcacagagagacagcacagagcagtggccagtgcattgcttctggagccaggcatccggatttgtattctggtgccactaatcttctctgtgaccttaggcaaaatgatttgccttcagtgtgccttaacttcctcatatataaagggggaaaataaccttcacaataagccttttaggataaaatgaaataattcatgtaaagtaacttaacaatacccagaacctagaaaaccaaataaatgttagctattaacttttatgaacatggattccaaaattttaaataataccaagttgaatacagcaatgtacacacacacaaacaatgcatcatgatgaattaggtttcattacaataacgtaagggcagagtcaacatcagataattcactattagcaagttaggttttttttttgagacagggtttcactgttgcccaggcctgagtggagtggtgggatcttggctcactgcaaccttcacctcccaggcccaagcgatcttcccatctcagccttccaaagtgctgggattacaggcatgcaacaccatgcctggccctatctttcttaatgtgtagcaattatcataattaatggtaaaactttagaagcaatttccatcaaagttaggacgtaaacaagggtgctttctatcactgtttcttttgaacatggcactggaggtcctaggcaatgtgttaggttaatacatatgaaattgccatttttttaagattatgagatgcccaacatcagaaatgtatgtgattcaacctataatagaaatgaaggaaataaaattttaaaattggaaagaaaaaactacctgtatttgcaggcaggtatgattgtctatgcagaaaatccaaaagaatatacagataaattgttaagactagtaagagttagcaaggttgaattcaagatcatctttaaaaaagaaaaaacctattagcattcctatacatcagtaataacaaattagaaaatgaaatagaaaaagagattctaggccgggcacggtggctcacgcctataatcccaggcctttgggaggctgaggcgggcggatcacgatgtcaggagatcgagaccatcctggctaacacggtgaaacctcgtctctactaaaaatacaaaaaaaaaaaaaaaaaaaattagctgggcatggtggcgggtacctgtagttccagctacttgggaggctgaggcaggagaatggtgtgaacccaggaggcagagcttgcagtgagcggagattgcaccactgcactccagcctgggtgacagagcgagactctgtctcaaaaaaaaaaaagattctattcacaatagtaacaaaaaccttagaatatatctagcaaaatatacgtaaggcctttcatgaagagtgttgctatggtctgaatctgtcttccaaaacacatttgttaaaatttaattgccaagataatattaagaggtagggcctttaaggagtgattaagtcataatggcaagtcctcatagatgacattagtgtcttataaaagggcttgtgtggggggtttatctgttccttctgctgcatgagaacatagcatttgtcccctccagaggagccagcattcaaggcaccatcttggaagcagataccaggccctcactagacactgtacctgctggtgccttgatcttggacttcccaacctccagaactgagaaaataaacttctgttgtttgtaaattacccagtctctggtattttgttatagcactacaaaaggcctaagacaaatacaaaaatactcaggaagagctgactaaattgaaatatagaccatatatattatgaatgggaggactcaatactataaacatattacttctcaccaaattaatctataaattcaagcaattctcaaacaaatcccaatagatttttttgtgaacttgacaggctgattctaaaattcatgtagtaattgaggggccaagaacagtgtgcagacaccgctggtgccctctccataccccttggcattgccaaccacatatatgccagggagctgatgcttttaagagcaccctcagtgtattcatcatgccttttcatttcctgaatttcctgatgttttgacagctgaggccttgctgatcctggagagactgttcctcccagggctagccaattccccgagacagtaagggactcacctgcaaatgcaccttccatacgcaaaccagccaatccgaagcccacacccccagccacctccttcatcagactgttatactgggccattgtccgtctaccctagtcatcccagggccatgaaccagacaaccagggacagccctatgctctggagccaagtgaaattatttaaactattaatagctaatcctgtgcctgcttaccctggcttgacttgcctttctcttggatgccacaaataaagctcttgcccacatttccccccagctccctttacttattgaccaaccctggtgcctccccatgtatccctgcctggcatgccatgtctcttgtttctagggacctctgagtataaaaaactctacttcaggacagtcatttccatatctgtgtgtcttgccatatctaatgaaaatcttgagtgcattttaaaacagccatgaagaaagggagttggtggataaataccacagcttcaccacccctcagctggaataactgaagggcccagtgagattgagccccagttaccttttgtggcaacctgctcattaatgtaccatctattgactttcttcccttccctatctcacttctcaccctcttaccttgcttcctggaatcatcttctaaaaaaatgcatgcacccaaatccttgactcaggctctccttcaagcagaacccaaatgaatatatttttaaagaataagaatgacataggccgggcacggtggcttacccctgtaatcccagcactttgggaggctggggcgggtggataatgaggtcaagagattgaaactatcctggccaacatggtgaaaccctttctctactaaaaatataaaaaaattagctgggtatggtggcgcacacctgtagtcccagctacttgggaggctgaggcaggagaatcacttgaacctgggaggcagagattgcagtgagccaagattgtgccactgcactccagcctgggcgacagagtgagaccgtctcaaaaaaaaaaaaaaaatgaatgacatagaggtcagtgagtaatggaaggtttaagatttgtgtacatacgataatgtcataggaatcaggacagttaaatgttgagggggatgtacaaattgaccactggaagagaacgggagcccagcaaaagatccatgacacacggaaacttgaaataagacagaagttgccttgtagatcattggggaaaggatggatattctaaaaacgatgttgggacaattgattatccatatgggaagtaaatacaactagatccctagttcacaccgtaccaaaaataaaatccaggttcattaaagatttagtttgaaaagcaaaactttgaaagcatttagaagcaaacataggaggatatcattatgactggggtagtgtcttagtgtgggctgctctaacaaaatgccatagaatgggtggcttaaacaacacacgttgatttctcccagttctagaggctagatgtccaagatcagggtgccaccatggtcggctcttggtgagggcccacctcctggttcacagagggccatctttttgtatcctcacatggcagagagcaagacagacaggaggcaactctcctgcatctcttcttatgaaggtggtgatcccatcacgagagctccaccctcctgacctaattactttccaaaggccccatctcttaacaccattatattggaggccaggatttcaacatataaatttagaggggacacaaatattcaatccataacaagtagaaagtaatttcctaaacaaaatactgaaagtggctgggtgtggtggttcatacctgtaataccagcattttgggaggctgaagcaggaggattgcttgagcccaggagttccagaccagcctgggtgacataacaagaccccatctcctctctctatataaaaaattagctgggtgtgctggtgtgtgtctgtagtcctgtacttaggaggctgaggcgggaggatcactggagcccaggagtttgaggctgcagtgagttgtgattgagccactgcactcctgcctgggcaacaaagtgggactgtctcaggagaaaaaaatattaaaagcataagctcaaaagaaaaatggtaatagatttgacttcactaaagtatttaaacttctattcaaccaaacataccacaaatgaagtttaaagagaaaccgtagattagaagatatttgcaattcatataatcaaaggatacatatctagaatatttaaggaattatatatataaacattttatatatataaacattaatattttaaaaagtcaaccaaccaaaagaaaagtgggcaaacaatatgaacatgtaattcatagaaaagaaaacttgaatgacctgcaaacataggaagaggtttaccatggataggagtgaggggaatggacacagaagtgataatgagatactagcattcctatacatcaataacaacaggttagaaaatgtattagaaagagattcagccgggtgcagtggctcacgcctgtaatcccagcactttgggaggccaaggcgggcagatcacaaggtcaggagatcgagaccatcctggctaacatggtgaaaccccgtctctactaaaaatccaaaaaaaaaaaaaaaaaaaattagccgggcgtggtggcaggcacctgtagtcccagctacttgggaggctgaggcaggagaatggcatgaatccaggaggcggagcttgcactgagccgacatcacaccactgcactccagcctgggcaacagagcgagagactccatctcaaaaaaaaaaaaaaaaaaaaaaaagagattctattcacaatggcaacaaaaaccttacgataaatctagcaaaatatacataaggcctttcatgaagagtattgctatggtctgaatgtgtctcccaaaattcaaattaattgccaagatgatagtatgaagaggtagggcctttaagaaatgattaagtcataagggcgagccctcgtggatgagattagtgctttataaaagggcgtgggggtggtagggccgggcgaggtggctcatgcctgtaatcccagcactttggaaggcctaggcgggtggatcacgaggtcaggagatcaagaccatcctggctaacgcagtgaaaccctgtctctactaaaaatacaaaaaattagctgggtgtggtggcaggcacctgtagtcccagctactcaggaggctgaggcaggagaatggcatgaacctgagagacggagcttgcagtgagccgagatcacaccactgcactccagcctgggcgacagagcgagacttgcctcaaaaaaaaaaaaaaaaaggaaaaagaaaaggcatgggggtgaatctgttccttctgctgcataagaatatattcttattgttggctgggcacagtggctcacacctgtaatcccagcactttgggaggccgaggcggatggatcacaaggtcaagagttcgagaccagcctggccaacatggtgaaaccctgtatctactaaaaatacaaaaattagccaggtgtggtggcagatgcctgtaatcccagctactcaggaggctgaggcacagaattgcttgaacccgggaggcggaagttgcagtgagccaagatcggcgccactgcactccagcctgggcgacagagtgagactctgtctcaaaaaaaaaaaaaaaaaaaaagtagatatcttattgttattttgagacagggtctcactctgttgcccaggttggaatacagtggcacaatcactgctcactgctgcatcaacctcctaggctcaagtgatcctcccacctcagcctcccaagtagctgagaccacaaccatgccaccacacctggctaatttttgggattttttgtagagaccgggtcccactatgttgcccaggctggtctcaaactcgtgggctcaagcagtcctcctgccttggcttcccaaagtactgggattacaagtgtgagccaccgctcccggcagttcatattattttgaaagccctataacagcaagtgctagtaaagatgtggaacagcaggagcactcgccaactgctgctggggatgtaaactggggctgccagtttggagagaaattgataatgtattgtaaagtcaaagatgcttccgtccaatgcctagcccttccatttctcggtgtgtaccccagagacactcatttatatgataatgctcatagtcacccttgtgtagtgagaattggaaaccacttagatgtccatcaacaagaacacggaggaatgaactgtgggatactcacataatacaatatgatctggagctggggccagcaaactaccgcccatctgccaaatctggagctaagaagaatggtttttataacattaaagcactataaaaaacaaaacaaaataaaacaatgcaaagcaaagactgcaacagagaccatatgttgcctgcaaagcctaaaatatctgctatatggctttttacacaaaaagtttgctgacccttgatctaaagtcacaattattaacaaaaatctttaaaaaatgttaagcaaaaaagttttgaatatgtacaaatcacatataacatacgtggacatatacatattagctaacatttaaaaacatgtttaaagatacccacgtaagtagcagaagaataaaattgcacgagtgataaactctaaattcagagaagtggttacctctggggatgggaagaaaaataatcatggggggaggttctgggggttttgtttcataaataaatttgctttagttcataaaatgaaaaaagaaggtctgaagcaaatatgactacatatgagtatgtttgaacaactccggataatggttcccaggtgtttgttatgtgggttcctatagatttatgtatgtttgaaatattttatcaattttgttttttttaaaggagtgccttttcatgagtgtgcccaggaggaggatggctgtggacatgggcaggcgccctccctgctgtgcacccggtcccttgtctggcctagccaggccccagctgcaggctgagcaattgtccataggccagagagactgacatcctggcctggggttctgcccgtgactgtcgtgtgcccttcttacagttgctttggcagtgggtgagcctagttggctccactagctgaggcccaggctgcagtggtgctggccagagaggatggagttagcagcctgggacctgccacaaatgacagcaggagtcagagcccaacttccccatctgtggagtgagatgatagatctcatggtgtccaaggattcatccagctctgttttcctgggcccagggtttgtcctaagacctgtagctgatgccttgggctccagactctctaattaaggaagtaagagccaagcagaagttggtcttcacattcctggcttttcacccccaacctgaactgcctttctctggcttccccatcagtgctggtgccccttgaggagaagccttacagaggaagagttggccaaaaggggcatttatgtgtgatttggaaggcagaaggaaagaggcagccattgctgtctgaaggtggccgtggccgcaagtggtgtcactggccaggtctaggtccattctgccggtgtacagcaagtcaatcactgtgacacaggtcctgatttatgcacaaggccaccaaacgaggagggggaagaacagctctcaaatccacctctgcagagataaggcttagggttgcttatgggctagggaagtgtgatggtctaagatgtggggagaggtgattggcagcggggaaaaatgaagtcataggtttgtttcgtgcaagtgtagtcgggctttgtgagatttcatagggcgtaagtgcagaaaatgatggcattagcatgatctgaaggtggagtatttggccctctgacatcaaaatggaccttttctcgggcattggcacaggtccagttgaagggtcagtgatctcaaccagtttgaactggacaggagctggcccaagttcctgaaaaacagctgaagcaaccatgaccatggcaacctatgactctgatctataaagcagccagtgatctataaagcagccagtgaaggttgaggttcagccttcagtggactaaggcctcagggttcatggataa

SEQ ID NO: 253 - DNA, 977399 bp, Homo sapiens
ttctctcacaggtagtttctgttgcctgcttttatttttctcttgtatgagtcacactttcctgtttctttgcgtgtctcataatttgttgttgaaaacttaattttagataatatattgttacaactctggagggcccccttctgcctcacatgtttattgtagtttgcatgtttagttgtatagtcacttgctgggctgttagaatagggtctatttccctcacagtatgaagactctgattttgctcctcagagggtgcaggctgacatgtgcacagtcagcctccaatacagtgcttttagaagggctgtcttccaggctctttttccatgatcatacccagctgttaagctctactaattcccaactgattgatctattgtttatacaatgccctggagcataaattgctccctagactgaaaacaattcaattaaacttgggttcctttatggggtaattttgagatgaatgtctgaggtttgcttggacccaaagaaggctcttcttagctctcttttttttctctcataagcttactggtttgtggtttaacttaaatccctcatgaaggtaccatcctcttcctaattgctttctaccaaaacctcctttgattttgagatccttaaaattgaacttctctacactccgttgaaagtcaagtcagtttttttgtttatttttttgttttcttatggcctatctcttcccctggaccaaatctctgagccatggctttggaattagttgtggggacagtcatatgcttctctctgatgacaacctagatttagaaggaatcttggtgggggcagcagcctctggtattctaggcgtacctcttgacacagaaccttctccttacaaattagctatgtttagggcaattggctagaaagaatctccctgttctatgaatgagggctgagtgaaagaaggtagccttgacctcctggccacactctcctgatatttagcctctgcaacaggtaattgtggggaggacaggaaatgctaaaggcatgtccttcccagaaagatgccacattccctttactgggttctggggttgcctggggagtgaagggtactactatgttattggctgtgctcacctggagtggagtttctgccgtgctgagctggcagggagaaggttgtggaacaaatgccacagactctcaccgttcttgatgagttttactagattttcttgaataaatatttcttcattgatatatatgtccttaaaaccacttccagagtttttaaatgtgtgtgtgtttaaataattttcacctccacttagcttgttttccttgggagtgggtccactggactccttacattttgattccatatgtcagaacccaagaatatactttaaatatatgacaccaaagatagaaatgtaaagaaaaactactaaattgattatataaaaatgtaaaaaatctttctctctctctctctttctttcttcttttctcttgagatggagtctcgctctgttgtccaggctggagtgcaatggcatgatctcggctcactgcaacctccacctcccgggttcaagagattctcctgtctcagcttcctgagtagctgggattacaggtgcctaccaccgcacccagctaatttttgtatatttagtagagaagggggtttcgccatgttggccaggctggtttcaaactcctgacctcaggtgatccacctgcctcagcctcccaaagtgctgggagtacagatttctaaagttaaaaggcaaatagaaagaaatattttcaacggataaaagtttactaccttaaatattctgaaatctttgactaatctctaggataaagatgaaaactcaaataaatgaataaggaacacagaggcaattcataaaatgcatataacacataaacataaaaaaatctttaacctcactagaattttttaaaaaaggaaaacaagaaacactttatgtccacaaattagaaaatatataaataaacttacaatactcagcaaagaactgaaaaaatacactatgatgagagagtaaattgacacaaactttggcgaaatgaataaatatcatattaaaaacatatataacctttccatgttgcatttaatttatttaaagacggtatatatagtgtgatgtatggctgatggctgtgtgcgtgcatgtgttttcgtgtgtattgtttttaacctgtaagggtactgctgttaacatttgcagagccctaatcaggaatacatattgcagagggcaggtagcatctgtaaacgtcttatctgaaactctcttgagattcaattaacagcatttactatcaacaatacaagccttgctaattggcacaattgaacatagcaatgattattatcactggtgaatgattattttctctggtgaaaagattggtgtttaagatatgggtctggctagaaatactgcacagtgagttttgcccttgcatagcacagaaggaaaatctggtgagccgaataacttataatcttaggaatgatgttttgtgattttgattccgatcagttctgtgttgagcagttttcagaggatttttttgcctgactccaagtaagactttaattgaatcctgcccttgcaatattgtcgcatttgcctctggtgaatctttgattcaaaaggctattggagaaactgtaaggacagaggagttgggactttattgagcttacagtttgaatagctgctttttaatgtctgctatgttgttatgtgtgcagaatttagccttgaattatctcttcttacaatttactacattattttgagggtgatgaggatgaggcctagagccctcattacctctaattgttgatcatggatatctaccagaaagaatctaataattatgaatgaggaaagtcacaagactttttgatatggtttgactccctgtctgcacccataattctcatgtgttgcgggagctgcccagtgggagacaatcgaatcacggaggcaggtctttcccatgctgttcttgtgatagtgaatgtgtctcaccagatctgatggttttgaaaaccagagtttctctgcacaagctctctcctgtctttgctgccctccatgtaagatgtgacttgctcctccttgccttccgccatgcttgtgaggcttcccaagccacgtggaactgtgagtccaattaaacctctttcttttgtaaattacccagtctctggtatgtctttattagaagtgtgaaaatggactaataccctttctgacctagtagatcaagttctgggaatttattctgagttaataatttaaaatgtgtgtaaaatttaacatcagtgtatttatcaatgagttatttatcatagcagaacacaaacaacttgaatgctcaacaatagagaactgattatctgtagtatattctgaaatggaatattaagcagcttttaaaagtgaggggatatataactattgaatgatagagaaaagttcaggacacattgaatatgaagaaactgatattaaaaacatgaacaaaatgaaaatatttaagaaaatatgtaattacagttatgtgaatacaatgtaaattgtttaggataagatgaaaagataaatgatttgatgaattctgtataaattgaatgtctctaaattgaatcgcataccatatgggcggatgtggccgtttaaaggagacatttggtacagttgaccctcattattcacagataacatatttgtgaatttgcccacttactgaaatttacttataactccaaagtcaatacttaaggcacttgagtagacacttgtagacgcacagaggtatttgtagatgcacagagaataaaaattgtagttgcccaatgcacacattcccagcttagatcaaacaaagtgatgctctgtgttcttgtttcagctctcatattctaaaaaagtctcctttttgcagtatatttagtgcatgtttctcaaattttgggtttttctgttggtgattttgctgcttaaaatggcctcgagcacagtgctggagtgctgtctagcattcctaagcaaaagaaagctgtgatgtgcctcacagagaaaatacatgtgttagataagttttgttcaggcaagaattacagtgctgcaggccatgagttctatgttaatgaatcaacagtatatattaaagaaggtatctttatcagttgatgaaaatcttgttaccagaggctgtcaggaacataaccctttattgtctccagtgtttgcagtgactttatagaacataattactgaggacatcagaaatcaactataaatacttttgcaactaatagacctttggaacaattatttttggattttgtataaagaatccaaaaaaatctggaaaacgtgtggctaagaaaacagttgattggtccctaattccaccttattatgtttaaattcagtgggtgtctcacagccacgtttataaaggaatcttggctggggtgtcaggtttctagtttactttgactctatctgtcagtctgtgtccaaccttcatggcaattaactgtgcttttgtgtgctaattatcattatcccagtatgggcccattattagtccaatgtccttagtttaaagcttaagtgtcaatcagtcacctaaaacaattgcatagaaggaagctttgcaaggctggtttgaaagtccttagctgagttctactttattatactccagttcgaaactgaacacaaagctcttcttgatacaattgtttatttaaatactgatttatctacttaattaaagcaaacttgagtttatattttaaaatcagggatgggataattgctactttatgcttgaagatctattcaggtagctatacattaaacaagtaaaaccgtaattataaaacctgcacatttttatctgattgagtcgctcctgccattgaacgaccttattcaagtcatttagaacaaagaaaggtggcatatatgagttttttaaaatcccactggatgccaggagtaaggagaaaatagcatcaaatcagatgtggtcagaaaagaggtatttcttttcctgtgatgcttttcctctttcctcctcttacagtaaatccccacttatcaaatcttcagatgtgtagagaaggaataaggcaggggtaatgggggagtgggacagagagatgccctttctggagtttgcacaacggttgcatgctgagtaaaacctgatgatgtattccattcatgtctccaaaaagtcaaaagcggtttcagcgttgatttcccttaagagttatcagtcctcattcaattggtttaatgagtgtaagaggtgaccttgtgtctatgtagatactcccatattaaaagacctggatgtaaaacttcacatatgtgtaaatagttattttggagggtgttgtgagggttattgcagctctctgctcagctgctactcaggctaaacgggcaggagaaattttccactgtgttagaatgatgattatttgcaaattacatgagcaccagtaattcattcatgcaatgatacagagctgggtctcagtgcagtggtattgaacttgctgctgggggcgttaattgattcgtttggaacattcccctccagagaatcccaatcacaggtcccctgatcaagaaacggacacgcagtcggggtcctggatatgtagagacacacgtgtgaggctgttgtcatcaaaataaaccatttctgtcccctgacaggggttgagtctattaggaacactccccaatcctgggagcttccgcaagaggctttctatcttggcagaggtggcagctgagcatcgcttctttgctgcaggatggaaaaaagggactggattattggctgcattttaaactagctgctgttctagagaaaatgttggggagggactgaacaagcttagcactggatcagtgtgggggtgtgttggtgaaaagaaaaaatgcctcctcctaacttaacgtttaactgatatcccctcaacacgacccaaatctgtctctccagatacacaatgtctgttttcctaactacatggtgaactgtggagcaagtcttggtcatgtttagtttgtttcccagaatctactagaagacaatgcctagcatatagcaggcacagaataagggccaaaggggagaatggaaacaaaatatgtacatttgaaatttagaaacacagttaagggactttgcctgaaattgtcataaaactttgaaaattgcttcaatgtatagtcccagtgggagaatgtgacagcatattttattctttgttcttttctgaaattctgtgtccagtctaaaacacgacatttccctttaatgtgttaggagtatgcatgactacacaggaatattttctggagaacttctggtgaagcatattttgataaacagtcttactaaaagttatatatatgtacttttaattgactagttgcagagaaataatcaatgtaaaaaaaaatcatacatagtacaggtagtaaaagtcacagttccggcagaagcacaaaagccttcaaagtgagtgggaacctgggaaccattgatcctcagtggctgtttaccatggaaaacacctgcatcaccaacattccagttttgcaaaagtacctctattacagacacataccaggcaaggagggaggaaaaagcctgaaaatttctctccaagtttaagtaatcaggaaactttggtggggaggttggggtggggtgggggcgggggggtaacttctttatttagcattaatctcagcaatcatgaaagtcatggaatttcaagtgatgaaaaatttgaccacaacaatacctatcactagcctggttttgcccacttctcgaacaggaattataaagataataattaattctaaaaagcagaagacaaaacaaacaaaccaaaccaacactgaatgaactaataaggctgctgcatatatatgttggagttggatgtttatttgcttactgcagtagtttaaaaatagttttccagttaacatcttttccacatagtggagatgtcagggtaggtttacatgattgcgtaaatggtcagaagttgtttatgtagctctgaactgctgagagatgagcaggaagacctgggttcagcaaaacccttggggctttttcccagagagagaaacagaggctcctctctgggttgctggaatgctttccagacgaattcgactgggttggcttttctctgcctgtcaaagtcactttgcacagtgctggtgaggggctggggcattgctgccaatctctacggttaccccgaggtgtggagttgcggcgaagggagccacttctgcaaggaaacagtagattcataatgtagaatgaccgtggcaacgtcgttcaaagcacattctttcgaataacaaggctttcgacatgccccacccccgcgcacaacacaccacaaattgatccttgtacctaatttacagcaactgttccctctgacctccccccgcccccgccccacattccaacctgaaagcactttgcgtggatgagacttcaggtgtgtaacgcagcctgtccagccagtgtcctccgcctaaggacaggcaggtaaaaacctaccaaagccccctcttctggcctaagttcaatgccacccgcccacccacattccccggttcagcaattttcagcccagacgcagaagcatctgtttccctggccagggcgccttaacgatcccccgaattccgcgtctcccggaggccagaggtttgggtacccaggaaggtcgcgcctcctcgtgccccgatactcgggttgtaaagggaggagacatcgcctcggcgcatccctggccgctgaacaacgcaacccctacgtccccgcacgggaatccggctgataatctcctcttgcctgagaatcgggccaggcgccctttactaatttcgcgcgctggggacctggggctgccgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagcgtctcccccgccccgcggctaaggagccggcagcccgaactccggcgcgccaggtttttccagccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaacttctggggggtttccagtttctttcgagaggcaagacaaccgccccgtcccctccccgggcccagacggcggcgaactgtgcgccgggcgccccacagaccccaatccactcactctccttctggaacgcggggctcaaaatcttcgtgcattttctctcttgtgcttcgtgtatatgttttactatttatgaagggtgtggaggtgagggtaggaggacgtgggctcctgaatccctctgaaccagccagagagtcggctgcatggaaacatttcgcagcgaagctcctgcgaggaggcggcttcgcgcgtcgggaagatcaggcggttgcttgctggccagggtctgcagattcggtgcgaagaagctggcggaggttgtgtagggcgagtcagtgtgactgagcaccctgggtgtgtggtctgcgtggaggagagtgggccggatcttgaggtgtgttggaggtttatttgtaagaggagttcctgaaaggaatgtcgtggaactttttctagttttcctgctggaatcaacataggggcgggcacatgtttgtcagaataacagtggcatttaactgcatgggaagctctttcaattttctgtagtgggagctggatagttcaaggagtaactccacataactgagtcgtttggatacccacacaagataatttggaacgcgcttgtatttttttgttttttgagatttctggtttatgtcctttagagagtggggtaggagcgtaaagactgtataggttgcctatgagcaggtccatacaatagcgttcccaagtctgcctaatagcaagtttgttctctctttctctctctctacccaagtgggtgaaaaagaacagtgtgtcatgaagacaggcacctggaggtgatttgggtggcattcatgagaaaattcacgttacccgtaagtttattcttgctatttttatcttgatttctttaaagattttgtgggaatatctgcagtgggtcgcaggagtaggtaagattgctaaggatcaaaaacaagtttcatgagaatattatttttgctaccttataaaatagctattgatttgtttgttgaagctggtttcaactgctctgtcttgttgaggagagatgatgctgataaacgtcattatttttccatctgaaccctgggaggtagctggcaaggatggaaaaactgaccttttcaattaaagactaagagtctaagagaagtgacttggataagggtgcatgtcagagccacatgtaagtttcaacagaggtagattttcctatttgcagttttttaaacaacacttttcagtttctttgagttgtaaaacttttcaagtcaattgggagtcaatgcagtacctttttccatggtcatttcatattggcaggtaattaagagtgattagagaacaaacctttcaaatgatgttggattttttatcattcacttattttacctacttctctctcctttttgttcaaaagtaggtcttctgatttcttttccgatctaagcactaaatcttttggctgcagtttttcttctgaaatgtatacagggcatccgttccttcaatttaggtcttaaaaaaataaagctgctcagcagaaaattcccatgcatggtactgacttttctacaagtttgtctgatcatgattttaacttgttgtttcttctttgttatatttgaggacagacataatatgcattagcttcaatctctcttatcttaaaaattaatattttgtaaaaacttgcttttatattattttagttgaataagtctatttcatatgataggcagggggaagtctctacacactgattttttttgttcctttttgttcatttttccctgtaatgctatgttttaagcctagtgaaggaggcaaggaggcaggatttactgcctagatttattgatcttcattattattattatttactatcagaagaaatctgacaacatatcaataaaatttatttataaactgaagacatgctgttatatgatacactacttataaaacacacaaagaaacaaaaaagatgaataaagcaaaaattatgaaatagaaggtctcatgttgctgttatgtatcccggtggatcattttgtacagcccctggggtgtgtagcacactttaaagatcactgctggtttgatatttttaaaatctttctctccttatctctgctctgctgttcatcatctctgatactctagccagttgtaaaactgctacacttctatatcttctgtaacaaatagattaagcacacttgttttcctctcatggactcatatgtggatagaatgaggtgtaaaggatgaatgtgttttggagatgtcatcttagatctcccaaagtagacatacaggtgaattttaaaaaatggagttttagtttaaagactaagtaccaatggtcaggaagtgaagaatccaaggagtaaatgagggaggattggaaggacactttccacattgcagtgttgtgtggaggctggaaagttcataaaccttgaagcagattaacctgaatctaagtctggcaccatcatttattacatttacagtcctgggcaatgtagttccttaatttctgtgagccttagtttctttaggtataaaattgggataacatctatttcacggcatcacgatagggattaaacatgagagcatgagtcaacatgggtcaagagcttggctcttttagattggctctttagcagatataacagatccaaaagggatactgcctcagatgtgaaatatatttatttctcggttgtgtgaagtcccagaatgggtgatcatggcagtactccttcaaagtgtgattcagagacccagccttcatctgttctgtgcccttgccgtcttcagcagggtcactgtgcttacttgcatcaagccattggaaagaggaagacttgggaggatgttaattgcccagaactggaatgagtgcatattacttttccttgcattgtgctggccagaacccagttctttgtggatgtacgttactattaaggaggctgggaaatatagtctagaaatgttatccaggaagtagaagaaattgttgggggaacaactagcattctctgatgttttattactatatgtgatatttcttccatgttcaataactgttacttccttttcttctcctaacccttgcttttttttttttctggtagaaaaactggaatggatacaataaataataatagaagcagttaatacatacataatgcttactattattgagatactttttaaagcacattgccctactttgcccttctaatattatctctattgtacagatgaggaaaactaggcatagagaaattaagttatttgttcatcatagctagtaagtagcagagctgggatctgaaccaggttctctcactccagaattgattttttaacagctttttttttttttgcttttgcctcaatacttttcttatttaagccactggaccgctttttacttttgcctatatataaaaaagttgccaagagaattttttaaaatactaaagtagaaaaaaaggatataatccaaaacatactggaatggaattagatatgatacagctttatcttgaatacctaccaggatcaggagcagatatttaaagtaactccccccacttacacacccttcaccactacaactgctctttcatttgtgataaacacattttcagggtctgtgccttgaattataaccttcctctgaagattctattgtgggagtcttgcgctaccactttcatgcttcagtatgtgaggataaattcctcttcacttctcagcagaaacaaatatcttccctggcaggtttttcagctaaaatagcctctcctaacttttgatcaaaggtattgctctttatcaatatccccatcctccaagaaaggaaaccctcttcttttcctatgagctttgcaaaattattttttatttatctatttatttatctttattttctatatgactaaggggactgtatatatatcccaggtaccgtctaaaagaaaatggtccctcttgttctcatcctgttgtcccatttccattagagaatctgcctcatcttatgtttcctatgtatttgtctttcataaaaatgcctgttagagttttggttcccagtggctgcagtggaaatgtgtagtggtcaatagtaagcgtatactttttgctaagatagttattgtttcaacattaaagagtgatttttttcctcttgttcagtatgtatttgttgcatcttcacaattaggtaatgatatgtatcttcttaccatgtaggtaggcataaatactgtatacctaccagtcatttctttcccagaagcccctgttcatttcctctttactttccctgagcctcacatcctgagaattttgcttttttttctgaactcctctttcttccaattttttccacttctgtgccatttatgtctacgtgtgtgtgtgtgtgtgtgtgtgtgtgcgtttcaagtcccttcttatgatttaatggggttggagggctggagaggttttcatgtgcttactgtcatgttttcagccaaattccacagggccttgtaacaggctaacatgagcagataagctcttaattttcagtgacttattttaactttttacttcttgctcatgtgtggtagttcagtactcatagaatagatcctgactgagtggctgtccatggggtcattcagggaatcaggttccttagagttttatggctttgttcatctttaagtacctagagtcctcatcattcagtcaagatacagagtgtgaggagataaataatccagagaagtcttattggaggttgttgtaggcacagcctggaagtggttgtcatgacttctgcccacattcctctggggtggacctcagtcacttcgacatcctttgctgcaagggaagctgagaagtggtgtctagctgagtgcctgggggagaagggtgaaaggaaaacaggtttggtaaataactagccagtctttgtcacaggtttccaatgaaagcatgtgagaaaatcagctaattctctaggtatggggaaaagagagcatggattttggttatttgccaaataaatgcccattgccttgcttccttttaattttgacctctattactatcccattcttagtgcatatggtctgggtgggattccgtttcccatttaaggattggagcatgggaaccaggtcttgtcgggaagagcattgacttttcctgtccacagtaattgcttctagaacagaacaggcatggacccagtgagaaccactgcagtgagatgctttgctttttctcagtggctctagttgggctccatgtatgcctttgaactaattcctgtagataaggagattagaaccagggagcatgtgggcctgccactgctgcagctgtcttaacaccaaaaagagaacctagacctgctgaggtcaccacatactacttgagaatgaagccaacagaacagtagcaaggggcatgatggagcaaaaccagctcctcttgcatcatgtgagcccgttaatctggctatgcctaaagtgagttaacctggtatattagtctattctcacactgctagaaagaactgcctgagactgggtaatttgtaaaggaaagaggttcaattcactcagttccgcatggcctcaggaaatttacaaccatggcagaaggcacgagagaagcaaaggcaggtcttacatggcggcaggcaagagacagtgaaggaggaagagccccttataaaaccatcagatctcatgagaactcacaatcatgagaccagcatgggggaaactgcttccacaatgcaatcacctcctaccaggtcccacccttgacacatgcaaattatggggattacctttcaattgatgagatttgcgtggagacacagagccaaaccatatcattctgcccctggcccctcccaaatatcatgtcttttcacatttcaacatgccttcccaacagtcgcccagaatcttaacccattttggcattagctcaaaagtccacagtccaaagtctcatctgagacaaggcaagtcccttctacctatgagcctgtaaaataaaaagcaagttagttaattccaagttgcagtgggagtacaggcactgggtcaatgttcctattccaaatgggagaaattggccaaaacaaaggggctacaggccccatgccagtctgaaaccaggcggggcagttattaaatcttaaagctccgaaatcatcttctttaactctatgtctcaagttcaggtcatgctgatgcaggaggtgggctcccactgtctggggcagttctgcccctctggctttgcaggctacagctcccctcccaactgctttcatggctggagttgagtgtctgctttcatggcacacagtgcaagctgtcagtggatctaccattctgaagtctagaggaccatagccctcttctcacagctccattaggcagtgtcccagtggtgactctgtgttgggagctccaacccccatttcccttccgcactgccctaacagaggttcttcatgagggctctgccccttcatcacacctcttgcctggacatccaggcatttccgtacatctactgaaatctaggcagaggttcccaaaccttcatttttgtcttctgcacacccacaggacgaacaccatgtggaagctgccaaggcttggggcttacaccttccgaagcaacagcttgagctataccttggccccttttagctacagctggagtggctgggacgcagggcaccaagtccctaggctgtacacagcagggagcccagtgccttgtccaagaaaccgtttttccctcctagacctctgggcctgtgatgggaggggctgccgccaagatctctgtcatgccctgaagacgttttccccattgtcctggctcctccttacttctgcaaatttctgcagctggcttgaatttctccccagaaaatgggtttttcttttctacagcatcatcaggctgcaaatttttcaaacctttttgctctgcttcccttttaaacataatttctaatttcagatcatcacactcaagtttaaagttccacagatctctagggcaggggcaaaattctgctagtctctttgctaaagcatagcaagagtgacctttgcttcagttctcgataagttcctcatctccatctgacctggacttcattgtccaaatcattattagcattttggccaaaaccattcaacaagtctctaggaagttccagagtttcccacatctttcttctgagtcctccaagtctctagtaagttccaaactttctgacatcttcctgttttcttctgagccctccaaactgttccagctctatctgttacccaattacaaagttgcttccacattttcgggtatctttatagcagtaccccactctctgcagtaccaatttactgcattagtctgttctcacattgttataaagaactacccaagactgggtgatttataaaggagagaggtttaatggactcacagttctgtatggcttgggaggcaacaggaaacttaaaatcatggtggaaggggagagagaagcaaaggtatatcttacatggcagcaagcaagagagagtgaatgagcaaaggaggaaaatccccttataaaacgatcagatctcgtgagaatcattcactatcacgaaaacagcatgagggaactgctcccatgatccagtcacctcccaatcaccacccttaacacttgggaattatggggattacaatttgagataagatttgggtggggacacagaaccaaaccatatcagctggtgattttgcagctcttcagattcataaattaccctttgacgtaagctgatttgggttggatttgtatgacttaaagtgaatactgatttattagaccaagcaaaaaagaggaaagaatactggataaggaagggagtgggggttttatttgtttgtttgttttcctgagctcatcttatgtcactttggttgtgtgcctaacagtttcactcccttgtaatacatcagacttccagtcaagaaccatttggcatacccctacccaggcacatagagctctcactaaattataaacccgaagctgttaattcttctcaaagctgatctctccttacagagttatggaagggaaatggaggtgaaatcacatcctcaggcttaattccctctttcaagattgcctgtggtccctcctggatgatgctttcttttccagcatcacttccctgttcctatcctcccccaggcttgcagaccaactgtaacaatctaatcacccatcctggaacttttcatgtgccttttcttttttttttttttttttcatgactgtttacattgcctctctctttggcctcctcttactgtccttgtctactgtgtttattacagtttgcacaatgctcaactcaagtatcactaagttaagcctctttcaatactattgaggcataaagaatggctccgtcacctgtacatactctcattgtacttgtttccatgccactgatataatatctgtcatgagaatgaccatctctcttgcttttcccaggacaggggggttcccaggatgctggatattcatttttaaaaccaggaaagtcttgatcaagccaggagaaatttgttgccttgccttctacattgtaatagctctcatttaacatgccactcggtgcaatggaatttcattgagacagtggataacagcttgaaatttggaggcaaaattcttaccaatcctagatccattttgtactagttgtgtgattgtgagcaagtgacctaacttttctaggttacagtttcatcatctgtgtagtggaatagtatgtgttttgtagggttgttagctaattaaaagacatcataaattaaatcacttcgtttagtgatggacacatctataacattgtctaaagcacacgagttttgtgaagattatgtagagtactacatgcaaagtacaagcaggacagtgcccaaatcctagtaagcatccagtacacagcttttgttatggattgttgttattcacttttaagtatctcttgcctaaaacatagtagatgccaaaaatacaattacactcagagaatacatgttcatggagcataaacaatgttactcagagtttgtgataagtggggcaagcaagtcagtgagagtgattaggaaatattttcgataattacttggtctttgaaacttgaaaaagctggaattgactgcaggattagttcctttttagaaacagtttgttttttcttgcatatttaaaccagacttcacaaattttcatagttcggaaagagaaaatattttccatgtttaggcaaggtcagtattggtgcataacccctaagtacatattttcattatttttattaatgaaataaaagtggcgcatttgggggaccaaaatgcaaatattttgtctttcttttggttcataagaaagtgaaggttagggcagtagaatcactactccattattaatcattattccataatgatcttgagttaaaaaaatcatatgatttgttgttgttgttgttaaccacagtgacatatcctctctacctttgggctgaacttttgtatataaaaatactttgtaacttgcacacttgtattaatataaatcttgagtgtccatgttgcctatgcctttcagttttgtcatggaaatttccagtgaggacaggtgttgcatgtgtgcttatgctgagatgggtccagtctggacaagaagacaatcaaacaaaacaatgatatgactcaaatcaccaagtatgttttgtaagatttgattctaggcacattgtcatcattttaagttgtgcaaatttgtattgttatccatattatgatgggtcttcaactattaattataaatacgaatttttttgtctttagtcactcatttgattagctattagctagatattgattctagactccttacagattagtgaattaattgggagtccaagcattatttttagtgtatttaattgggtgaatgacagctttatagagaaagtgattacttaagttgcatatctaattcttagtaaaaaattatagtacaaacaaggtcatctagaattcttggatctaagtaatggtaaattaagagttgcttttaatataatagtatcttttaaaaatggatatccctgtaaaatgtcttcattttctgcttaagcaggtgactaaagataatttacttcttgatgacacgggatcaccatgataaacatagtttggtggtttagaatagagtatgggccttggaatcagacagacctggtttgaatccttgttttgtctcttactagctgtgtgatctcaaacacattcttacttttcccaaggcagtttttaaaatctgtaaagtgaagttgatcctgcctgtcttacagataggctgtgaacattaatggtatgcattgaagactttaggacagtgtgcatggcacattgtaagcattaggtaaatgaaccgtatactacaatctttacaacttatacagaacgtagtatacttaaatgttttatatatttgttgttcattgtttcaacattctttgccacattcctgtgacactgggggatgcaacaggatcccatccagtgcagctgaagtgttgagaccgacactggtgacctccatctgctttctgctgcctttcagattgtcatattataatctttcgctttggtgaactagccttttccacttgctgttttccaccatttgtgaactggaaaaataaaatacacaagctgttcaaacattcttagtaagagtaaacagattcggagtgagactgtgaaggggcctgtttctcccctccccgccttttttttggttgttgttgtgagagagtaatggtatgggtgtttcacatccattttcactgttctcagctttacctctctacttcctggctgaggtactgagagtaagatatcactataccatagtggaaatagaaaataacctgctttgataatattgtgacatgtatttgtgatatgcttggcagtagcatcatgttagtgaaaattcctgtgttacagtgtggaatgttggctatcttacctgtagtacaataaacttcattcaaaatcctgtgcttagaatacagcatgatctttatggtataaagaggttttcttttctatttttttccagcacatttcaaggtcttactagttactagagtctaactcaaaagccttagtatttaccctttattttcttttttaaatccagtggtcagaattcccgataccaaaacaattatggatactattaaggtggctgtaatgcttatatacgcactgtgagttcattgagaattcatagttctgttaattctactcaattcttataataattgaaattcaccagcatattgttgtttatagtatgtggtgtaagtgaaattaatacttttcttttaaacattagtattttcagagaagaaccttttcctgttcttctgaattaatgaattgttacaaatttttgtaggtttcttataatgtggctacttaaatcaacatattaaggtaaactcttaagaaaagaaacataatataatgtactccccaaaataatgaatcccatgttttaggttggtatttagtctccacagctggaaaacactattttatgtgatgtataggaaaggctggaggcagacttggtgatttagaatgactcagtgattcatatcctgtctctactacttatgtatttagtatatatacaaatatatattaaagttagtatgtaacatcagaccaagtcatttaaccttttttagcttcatttttctcttgtatataatggaggaattcctgtagggttgtgaagactaaagttacttaattgtatatacacatagccttgtgccaggaatataattagaccatccctaaaaatgctgtttatcatgattttaccctttcaatgcatttattcaatatgatgcttgtgttgtagatgaaatatgtggatgttatgatttacaaacttgaaatttcattattttaaaatactctgtaaagtgatttatgtttgctcatatgcttttatctatgggatagacaatgcaatcctctctgtgtggagacagaggaaggcaacatttccatagtgtgttgttttatggttgactattactgcgagccactgtatcagaactgagatgagattagcactatttgagattttattttggagaaatggttttggctatggtcaagaatcttatttattagaaagaatgaattactgaataggctctcatctgtattctttctacttcagctatagcccatcttgccatcctgtaaaagaaatgctgacagtgacagaggagaaatataaaaatgtttccagttgctttcagtcaaatgtgattgaaattttataaaagatttacacattttttatttgtaatactgacagtactgggaaatgaatttctgtttactccagagaatagcagtcactttataggtgctttgaattttaaaacttagcaagcataacaataatgactggtgtattattaacatgcatgtaaaaggagtttaacatatctgaagagaaactggttaatgttattttacttcctatgtgtttttacagcctttcaagaatgaaacattggtagtaagtttgttttgaatgtttctctatttcatctttgtatgttggtttactacctattgtatgggattcaaagaatgtttatatcaaaaactgttttgtttagagcttatcattaaacctcattacttagatgttttaattacttttatatgtttctttctgtatttctaacacatacaatgagaatttactgttttccattgtgttttacatttttttcttctggtaagttactaagctaactcacatcagtatcttaattcctggagagagacccccatccatttatgtatatcctatagatctgattatggccttgttatggaaattggcctgactacaggcttctagtcattcatgccctagtattctcccctgttaggtaatttccaagatgcaccctctactatagtttctaagtaattcttctgagcaccagaccaagtattcatggaaggcctaaaatatatactttcaatggaaaggatggtagaaattcagccaattctgctttcttgggcttttagatattaaaaagagctatagaaatataattacactgatggatttcactgctctcaattgcctgaattatcagggttgagcaactgaagcgggtggaagggctgtttcccttatatctgaatataacataataaattgtccatcaatagggactatttgagtttgatattgatctttgatgttatgtatgctgcatttcattgattaaaagcatgcattctagttgggtctagatatacagtctaagtacatgatctatagttcagaatagagtatcatttatatagaaatttgcccatggccgtgttgtaattgtagcccattgattggcatctccaaggagcttgtgagaaatgcagaaattttttcctcacgcagatgcactgtatcagaattttcattttatcagttgatttttattaaagattgatagacattgatttgcattgtattcttaactaactgaaacaactggttccctgctacgaagcctaaatgtcaagcatatacacaacctgcttaattgtatagtaaggacccaatactataggatgaaggataggtacagttgagtttggccaaatgatgatcagagtctatatagtttaaggcgcagatacacaaattttcaaaaatatgggtagaatatagtcaatatgaatggaatagacaatgctttgaaaatcactggagggaggctttattgtttgtgaaaacatgttgtcatcactttttgctttaagcccttggtggtgaaataactcaaaccattcttccttatgctgaagatcgagaaccccaagtatcacatctaccatcccactcatcaatgtgattggtcagtctttgctgaggtcctgcatagccagttttaaagttagagttcttgcatatacatatgaaaaggcatgttacttgtgctttcaaagagctttttgcttggtgtaaaaagaaaactcaaattacagtgtgatgtggaatataatggtggtagtttcatcgagatgatgggaaagaattgataagataaagtagaaagatgagcagaattttcagattgggtttggaaagagcacttaagaaagagggtggccaggtggtggctcacacctgtaatcccaggactttgtgaggccgaagtgggcagatcacttgagctcaggagtttgagaccagcctggtcaacatggcaaaaccccatctcaaaaaaaaacaaaaaaatacaaaaactagctggcgtgttggtgcccacctgcagtcctagctactcgggaggctgagttggtaggatcacttgagctagggaagttgaggctacagtgtgctgtgatcctgtcactgcactccagtctggatgacagagcaagaccttgtctcaaaaaataaataaataaaattaagaaagagggtatagtatgtacaatggccatgggcttatgaggaaaaatggcaagtttggagaatgccaaaggtatgagtggacgctaggggtatgggaaggtggcaatagggccttcatttacacagtttcatagactagaatgtgaatgttatccccagagttggaccaccaacaagcagtgactgtgattgttgcatcatggctttgtgcaaagtagcatctctagcgaatgggacaaattggggaatatgagggaattgggagatattctttatgctgtagaaagccactgcaagatttatatgacaaggtatacagtgctgatctgctgaccaatatattttctggcatcattccgtgtttctctcttgtgagtgaggtgcattcctttgctaataacatttgctgtcctcagacattattaaaggaaatttaatgctgtttgacaacatttcaagtagtagccattgatattgtcatggacatttattgttaatcacaggaacaagtttccttttctaacagcaaaatctcttccactgtttgcagtcttgtgtgatgatgaaacctcagcccaccctcctaataggcagtggaccatgaggcctctctgatgagccttcagccaggctcttctccttgctccagtacatcatgcaggcatgtgacctaagttgcaatgatcagaccctctcctcatacgtagaatcttgggcttagtaacataaggatgaagaaatggttagtagatgtatgctttttactgtgtcagtgtcctggccccactgaacatggtgtgtggtccaatattaatggtatctctactgggggttttggagctgctttgtcctctagttcttccttctattccatgcgctctccatatccttttgatagtctccttttcccaaagttggttattctttcttggaaccaaggaactataaagagaaatggaggttcttccaggtaaccctgtttatcctcttagctttctgttagggacatccacagcacgagacacacaagttagcttttcagggtgcctcttgaggcctgtccaggaatttggaaaattcatcctcttaaacagcccatggcattttccacagtttatggtaagtactcttatctcagtattctgcagaatgcagaaaggtaccttgtaaacttggggtataaatctctctattggttttcaagttgtggtgtatagctttattcaaagggaattctaacatttcatacaaccgcagctgccatgttatttcttttaaaagcttgtgccttctctgaataattcatattgtccagtgccttcagattgtttcataagatcaacacctaaaaagtcctttcttgttctagctaatacttaaagactcttttgcaaatgtgtttctagaaattgttatcacagttagggtgggcatttagctttttgtgcctagcctgtaaacttggtcttattaactttgggaaccatgagtcttggtatttatgcagtgagacttaaatctttctcgaaggtgctttatagtaacctgcatgtaaagcctctaacttgggcctggcactcatcattgggttggaccccaatcctgatgatcttcaaatcctctttcatacatagccatcaccactaaagtcttattcagctaatgttagaaacaaagcattgcaggaggcctcatatctagtaaatgcactttcatacccagtttactgttatcctccataattaacgtgaggcataacagaaaataatcatagaccaggcatacatctcaaagcttagacatgttatgaatgtcactccacataccagctccaatccatcattcctgtcctcagcttggaagtggaggaggggagacgtgtttatgggactaaatataaactctgtggggtaattgctacaaaatgtcatcctcagaaacacctgggagctttggaagaaaataaaatttcacagccccacgctaggtaataccgaatcagagtctctgggaatgagttttaggaaactgtagttgaataggctccccatgtgattctgatgttcagccaggtttgagcgctaaagcatgttctgtggaacactaattcttctaggtagatataaataggattccctttaaaagtgttcttaacaaaaacagaggaaattcaggattttaaacaggttttctaacacgagaatttttcagaatctttatgtgcattgtgaaatgcatgtttctgactatggaacaatcttgcttctctatcccccctgccaactccctacccaacacaaagactctttactaaacatctaatgttgcagatttcagccctggctcctccttagaataatccggttaatcgatcgatctggggttgggggtgggttctgtgtgggagaaacaaactcaaagtgtgttttctattctctcactcaaaaacaatcaatagagaagatttttgtgaccaaatttgtgggggaatcacccacacatcaagcaagcaatcagttttccagcagacactaactcagcgtcctctaattcagttcagtactgacactctctacttagagatagtctcagatcacagaggttgagggctcagtcccacaagactgtcccctactcccaatgccacaggcaagcctctggttgcctgttttaatggcatttctaaaacagaccagctataaattggtgttcccgcaacctcctccttgggttcagttaatttgctagagcttctcacagagctcagggaaacacgtttactggtttattataaaggatgttacaaaggatacagatgaagagattcagagggtgaggtattggggaaaggccccacactgggcctttcatgccctttctgggcacactaccctccaggaaccttttgtgttaagctgtctggaagtgcatctgaacgctgtccttctgcatttttctgggagcttcattaggtaggcatgattgatcaaagtattggccattggtgatcaacctcaccctcagtccctctttccttccaggaggttgggggagggggctgaaagtcccaaccctctaattatatcttggtctttatggtgaccagcccccatcctgaagctacccagtagctgccagccattcatccgctaattagcatacaaaagattttcctttggaggtcccaaggattttaggagttttatgtcaggaaatggggtgtaggacaaatacatatattttaccacttcatgggctaatggaatattttaaaatttcccgggtgattttattagacacgcagggtttaggaccacagatgcgatgtaatgttctttggaagacattctggatgatttatttatttaacaatgtgtcccacatcacccagattttttagtttcacatctgtcaggtggttttactcaacttacatatgtatcatcctatgtttagagcttgtttttaaatatctttttttctgattataataaaaactttttcttagaaaaaacaccccagctattacagacactcttagataaaaatgcattggttgtctaagtgaattttaatcataatgagtaatattaattgaacatttataatgtaccaaggaagtcactaaatgtttttattatattatctcatttaaacctataatagtcctgtgagctagatgctgtgatgacccctgggtcctaaatgagaaaactgagaatcagaaagagtaagtaatttgtctcaggtcatgcagctaataaatggcaatactgatatcatatcagatcccaggtatacctgattgtgagctaaagctcttaaccaatttggaatcctggttaagacagaggcttttatgtttagtgatcagtgtatgcttaaaaccccttagtatgtacatgttactttgtgaagcacattttattgcaaggaaggtgaatcttcataaatgacaggggtttaggaaagtattccaaatgttaagaaccattttaaaatgggaagattttcaaccaaatatttgcatatgaatgtaaacagaatttttgtagttatagtagattggtaatttgtgcatgtaagttatatattattcattaatctgaatgtatttgaatattccaaattcactgtttacatatatttttcctaccgataggcttccaaatgttgctaagcttccagaaatattgagtttgatagatttttttggttcctctggccagaaatttaaacaaaaagaaaagaatgatttggactactggcaataaaactcagtgaaggggatttatgtacgggtccgaatgcatgcttattagtcactcagaacatgatgtttcattttaaaagtacatgcctttgcatcttgttatgacatttagaaaaagttttcagttgcatgtctttcattttgccagagaagataaattgactaatatgtaaatgacattacagggtccaagtgtaatggttaattttatatgtcaaccaggctaggtctggatatttggtcaaacatgtctggatgatgctgtgaagatattttaaagatgagattaacatttaaatcagtggactttgaataaagcagatccataatgtggtgggccacattcagtcagcagagggccttcagaaaaaaactgatctcccaggagaaagaattctgctagcagacagcttttggtctctggctgtgacattaactcttcattgcttgtccagtctgttaacctgccctgcagattttgcacttgccaacctccataatcacgtaagccaattccttggtgtgtctctttctttctgtctctctctccgtgtatacatctagtccatcctattggttttgtttctgtggagaaccctgactactacaccaatattccttattctccctgtatgagaaagtttctctagctgtttttagaataattttatttggatgtccttacccgcaaaatcaactgttagacttttgcagaatgattagtgatggatcataccaaatactgccatctccaacactattgatgtttccccaggcattgggcaatttcatagatgccatatagagtaaatgggaacacagaaagttcaaagatggaatttgttactccctggaaatttgtagtggtaaaggtttccaggtgtggcttttgtcttccagtccaagtaggataatttagagaaatgggaaaataatctctttctagaatccacttcatttttccatttaacctacaggtatcaagtgctactaagccgtaggaccaagctagatcctatgggtagaaaagaaaagaagtggatatggaacttgccatcatagagcttagggtgtggtaggggttacccaaaaagagttaaacaattaatactttaaaaaattataaactgtataggggctctgaaggagaaaaggaaagtgctgagatagtgcataatgtgggcaggatctagtgtaggtggcagagtcaagaaaggcttcttggtaaatgtgaattttgagacccccaaacttgagatggagctagccatgcaataaccagggaagaaagttccaggcaacgaagacagcatgtaaggggcagtaggtaagtaagagcttgactcataacctgatttaagttttaatgtacaaacaatcaagttgtcatgggtcaagaaagccttagactaagctgagtgaagggggctctaaatagaatcatataggagaaataacactgggaaaatgaggatagtttagctggattctactttgagagtatgataaaggagaaacattagtttcacactttactagtttttaaatatgtgtaacttccatattatttaaactataacatgaggcatttaggttatatatatatatatatatataaatatatatatatatatatatatatatatatatttttttttttttttttatgcagagtctcactctgtcgccgaggctggaatgcagtggcatggtctccacggactgcgagctcgcttcctgggatcaagcaattctcctgtctcagcctcccgagtagctgggattacaggtgcacaccactatgcccagctaatttttgtatttttagtagagaggagggttctccatgttgatgaggctggtcttgaactcctgaccttaggtgatctgcctgtgtcggcctcccaaagtgctgggattacaggcatgagctactgcgcctggctgataaataattttttaagtatgcatgtgactctcacgagtgtggactgctagctaaggctggctcatcaatatttgtctagagatcttaaaactgagtgaaatactgtctaagtgaattttaatcataatgagtaatattaattgaacatttacagtgtaccaaggaagtcactaaatgtttctattatctcaattaaacctataataatcctatgaactagatactatgatggcctctgggtcctagatgagaaaactgagaatcagagagagttagtatgaggctcctcacactttgggaggctttctctgcatctgaagccacttgaaagtctagactcattgactttgtgaattttaatgacttccttcctccctcccttccttccctcccttcttccttccttctctccctccctctcttctttccttcttttttccccttcctctctttgttccttcctccctcttaccaaatgctagtacagcactggatatggtgaatatatcatttcaggcataagaaattatatgccgtgtaatcccagcactctgggaggccgaggcgggcagatcacgaggtcagaagtttgagaccagcctgaccaacatagtgaaaccccgtctctactaaaaatagaaaaattagcccgatgtggtggcacgtgcctgtaaacccagctactcaggaggccgaggcaggagaatcgcttgaacctgggaggtggaggttgcagtgagccgagatcacaccactgcacccagcctgggtgacagagtgagactccgtctcaaaaaaaaaaaaaaaaaatgaagttgtgtgcacggggacccatatcctccagtcctatagaattgtaagttggttactatagaacttgtgctgtatttggaacctttcactgaagaatataagcaaatgtcaaacctgtaatttgtcagagtttccatttcacaatctgaagaactgaagtgtacaaccttcactctgcattgttgaaatgaagagaaagagttaaaggtaattatccatataatttgaaagaaaaaatgtctccttctgctcaagaagtagggtctgataccttgattaatttgtactggttactaatatttaatttccctggatagtgtctgaactttccatttcagtttgccattgtaccccctttgtattttaaaattatttttctttatcacacctgtaatcccagcactttgggaggccgaggtgggcggatcacgaggtcaggagatcgagaccacggtgaaaccccgtctctactaaaaaaatacaaaaaaattagccgggcgtggtggcggcgcctgtagtcccagctactcgggaggctgaggcaggagaatggcgggaacccgggaggcggagcttgcagtgagctgagattgcgccactgcactccagcctgggcgacagagcgacactccatctcaaaaaaaaaaaaaaattatttttctttaaaggttatttgtctatgattgtgcattttaatagtatgaaagggtacctggtcaaaactgtttgccttttgtcactttctgctaactcttttccctagagacaatgttactattatttgtttatcatttcagagatctttattgttatatgggcacatataactgattttgtcagttaaaaaaatctgaatgcttactataaaaaatgatggcatggaatatttttcttcacttaaagatgaatcttagatgtcagtctacattaatctatatgtagctaactcttccctgcgaagagtatttattcctttgtacaaaggccataatactagaacttgctcataagaatttatgttctttacagactcttgctatgataaacaatatctttgtaaacatgtgtgattatatctgtaggataaattcctgaaagaagaattggaatttttttggtcaaaaatactgtattgtacatttaaaaacttttataattatttccagattgccctgcaaagaaattatcataatttacattctcaaaacaaggttgtcataatgtttgagttgatgcagtagctccttagcaattaatagacgttcattttacaatctgtcaacatttgcaactttcacgaagcctcacaagtgatcgtgtacccaggtaaaacagcttatgttagacattcttgtgcaaggtttatggttggctgttgttcttaatcctttccagttataagagctcattgaatgtctcagttcaaggttgccatgttatattatgagacattgggtactgtcggtgagacttggcatgactggacgagccattctgatctttgaattacacagcaagtagaagccaggacagtatgttcttgacttaaggcatcctcagcaaagtgataacctagctgatcttctgagaaccctcagccagacacagtggagtttatggtaaattatagctcttgttgagcattgactatatgcctagcacccttgcatatgatttctaatctttacaacaaccctccaaaatgggaataactatcctcactttacaattttggaaatttaagttcaaaacggctgagtgcatttctcaaggtcaaggtcacataactaataattggcagagctatctccctctgcctgcttccagaggagtttttccttttattgcatcattgcaattgaccatcagaatcacttggctttactaattttttatgcattaaacaggtttttctggtcagtatccaggcaaatttaggcagttcttgtttggaagggtcctttcctttggttggtccagcttttgcacccctgtacttagagggatgctcagatgctcagatgtctttgctactgctgtgtccagctgtggtgtatcttcccatgctgaccctactctcatgtttctgaactgacatctcgcaagattaattgagatgctgtagttttctagcgctacactggctgtaattagtcgctgacatatgatgatttattataggggattcctttagaaatttactttgtgttttgggactaagaaatgatcgttagagtttcagacttacagctcttgtcctgcaccacttaactgatcaaaactatgtttgggatgaccaggcagcttgacatcatagcactggtcatcctgactctctaagtaaaactgaaatgtgtggcaaattaaaagcagtgaagatggtgcatggctaaattaattcatcttgattaggccctggtgaatttttaaatatataatcagatgtgagaatttaagatgtgggatagtcaaagccaagaatccaggaagacttctagcaattccacaaagacaaaaagcaaagatgccagaagactgtggccaggcttgcttgtggaatgaaaataaggggaaaaaaatcacttacaatagattaacagtataccctgtcaaagagtgtgccagaagtcacgtaaaattcccaacccactgacagagattttggagaggtgatgagagtgaggggaagggattatctgaaaaatatgaacaaggcagtagtgaggaataagatgccagcatcaacttccgctgtcacttgttttctcaacggttagccatgccactaaggtcaactcagtatgttattaaaatgggcggttttaggtaatgattactttcttggcagatagaggattcttttatctttggggtcatgcatttttaaaagcctttgtctgcatagatttatttaaaacacacacacacacacacacacacacacacacacacacacccccttaagcaaggtatgctggctcacacctataatcccacactttgggaggctgaggcgggaggaccacttgagcccaggagttcaagaccagctggagcaacaaagtgagctccttgtctcaacaacaacaatgacaacaacaacaacaacatctgggcatggtggtgcatgactgtgatcccagctacatgggaggctgaggcaggaggttcccttgtgccaggaggttgaggctgcagtaagctatgttcatgctactctactccagcctggaagagagagtgaaaaacaaccaaccaaccaacaaaaaagcagcttgattgaagtgtagttgatgtacaaaaatctacacagatttaatgtatacaatttgcggattttaatatatgcaaagatgcatgagacaatcagtacaattaaggtaataaatatatctattatctccagaagtttcttcctgcccccgctccatgtttttactggtaagatcacttgacatctacttgcttgacagatttttaagtgcataaaacagtgttgttaactataggcactatgtcgtgtagcagatctctagcacttattcatcttgcagaattgaaattttataccctttgtacccttgaacaataactctccatttttccttcctctacaggctctggaagccaccattctactctttgtttctatgagtttgactattttagataccttatataagtagaatcacccagtatttaaccttctgtaactgccttatttcacttagcatactgtcttccaggtacatgtatgttgtcacatatggcaggatttccttctttttcaaggctgagtaacattctattctctgtgtgtgtgtgtgtgtgtgtgtgtgtgtgtgtgtataacatgccacgttttctttattcatttattgatagatatttaggttgtttccatatcttgactaccgtgaattaagtaaactccaatgatcatgggagtgcagatatcacttctagatctaaatctttgacatcttgacttcaattcctttgggcacagatttctatgaagatttcttttttctttttctttttctttttttttttttttgagacgagtctcacactggcacccaggctggagttcagtggcaccatcttggatcactgcaagctctgcctcctgggttcaccctttctactgcctcagcctcctgagtagctgggactacaggcgcctgccaccatgcccggcaaattttctgtatttttagtagagacgggttttaccgtgttaagcaggatggtctcgatctcctgacctcgtgatccgcccgcctcagcctcccaaagtgctgggattacaggcgtgagccacagcaccaggccttctatgaagatttataagttgctcagtttttatttctggtgtgtgtgtgtgtgtgtgtgtgtgtgtgtgtgtatgtgtgtatgtgtgtgtgttttaattttaaaaaccctgtcatatttaggatatacctcgtgatgagtgtgatcagcactaattgtcactctgttatactaaaagctctttccgtagtgtgtcttcattgcaagcatccattgtgtatggaatcctgaatacagttatttgaatgtctgagtattaaacaattaactgtctttacagaatgtcctccggggaacatagtttttccttagggacccttgggatctctaaccgcttaaaatctagaagctcttatgtgataggatgggaaattaaaaaataaatctctactatatgttaggatgtccatactgcatatagctccttaagataatggactatgattctatcttgtctctgcgcccagtacatggcacatttcagggtgtcacagatttcctaggattaaaatgcttagtaaatatatgaatgaattctaattttagtttctttatctggcaccttttcttgtactttctgagcaataagaagtaggtatctgggtttctagtagatttatgccatataattaagaaatattgatttaataatttttgtgtcctgtgaactttatttaatcattagctaataagatttattgagcatcttgcagttctgtagccctgtgcttgatggtgttagctccttagcacgtaattgttttgactagaatggtaatttaaggtaatttgatatacaaaatggagtgctatgtatggcaaagttgagagggggtgaggagaatataacttcaaacctgtttgaaaactcatcaagtaatatttttcttactttaaatgtgctttggcctcctttgtgtgcaagcaatagagacctatttaggctcctttaactactgggggtttatcaaaaggtgaaatatagaaataaagagacgagaaatactgtccacatgggagattctgatgtgaattctgggaaagctgcacaagtgtggcacacctggacctcacctagatggagggtggttcgaaactagaaggtcctttgtgacttttgtctgatgaggagtcctagcagtttgaggatccagttttcatagttacatagttaatttagtttaatgacttattctgtctttttcatctttgtggtttgcgtttttctcctttctcaatgaattgctagctctcttctcaagagaagcctggattgcttaagttaccatcttcccacctttgtgggcagtgcccttgctggagtccacctgataccctgtggatcagctgccctttgtcgggttcccatcacagccccaatgtgctgtgggtgaaggggtggccagggtgttgagagagagccaagtccatcagagaactttcagaagtaccttgctgtgaatcatccttcacagcctagtgggtgccgctcctcccttttattcaattttttaataaactcaatatttgatcaaattaagtggagggagggaggatggaataacatgctcctgatataatggaaaattcaggctcattgaacttgtgtgatgtgccacaatccttttagaacaagaccgtgattgaaactagtctcttttctctattacttttttgattgttttaaaaaaaatcaagaatatttctaaaatataaaaaaaattacaggagagataatttgagtatcttcactttttacactcctgccaagaatgccccacaaccccacccattacagaaggatcagattccatattggaaatatatgccaatttcaatttagctgctcagtaccaagaattcttgcacctatgagatgctaaaggtttgaactaaatggagccacattcatcattgttgtagaaatctgccagtgtttaaaaggtgctacagggaacctttaagtcatgcaccaaattaaaagattgcaagctccactggtgtagtcaaaagcaagctcaaagctgagtggcatcaaaccaagagtagaagataacttgttactgaattttgttcttcctctgaatgccactctttcaagcagagcgaggaaaatatgaattttgtgttgttaaaagatgtttatttccacaccctaatttatgtttcaaactgcaggcttttgcagagagtgtttctctgaaacttttaaagaaagtgacatgttactacatgggaagaaaagatagagcctggttggtaatgattatacagtcagggctttatctgcttgcagataatttgtggcttatttttaaccgtctgccagtttcttttctcattgttacatttacctgctgattgcaaccctgagccaatcagtcactggtgagcatttggtgaattctacttttttaaactggccaaaagaaaacacatatttccagaatggacacagtgatactagctaatatttattgaatacttattatgcagtagattcaatattttaaatttaacatttacagaaacctcaccatagcaagaattatcattactgttttactgatgaatagggtgaggcttagaaaggtaagtaacttgtcaaggtcttaaaggtagtcaatgtcagaggcagggcttggatccaggggaaacctggtcaattttaatcctgcactgagaggtgatcacaatctgaagactgtgatcgacactaagacagattttgtcaaacaagctggtatcatgaggaagtcagtttggatgatgatggtatcccataacatgtctcaagaagaacttaggatgtttagcttatggtggtgtaaattcagtgcaaggggatgtaataggtgtcttcatttacatgaaacaatttcaagcgaaagatgacttagatctgctttgcatttgcacaggggtgagatgtaagacatattaaagaaaaccataaagagccaactgaatgaaatgattcatcaataaatgtgtttcctcaacgtatagtgagtgtcctatcaatggaaactttaacaaaggagctagattttggttttacaggactcttagatctatggattaagatgtgtctgtaatattagatgtatcttagagaataattatccaaaatatacttcatggaacatggaggaactacagactaacattttctatggtaaaatatttgggaaatgcttcattttttctttcataatatattaacacgttaaaggccaaatcaactatttaggaaaagaaaataaaacaaaatttcaccaactttatgaagctaacatttcctgagctttaacatttttcatttgttattattttttgatactaggaaagccttcttgtgatactattaagatcccatagaacattgcaaatgcttgtccaaacctgcaaaaaaaaaaaaaaaaaaaagcgcacatcatgtgcagagacttcccatgggcattgggtgcagctatttgtaatgagaaacaaaataactgttggcttccgtagtggacttgtgagaaccagtagttttgcatggtgcagggatagataagaaagttgttttcgatatgctattttggattctctcactctaggaaataatcaagtgttgatggtattaaatttcctttagcatacatgcaaagagggcatgtttatagactttgacttgaacttcttctaacaggccttattttccctgagtatgtttctacttacttaaaaacagatgctctctgaaaaattcatgaaaaccaaaaatatgctggagactttggagagaagctcttcaccctgttattaaagttagattgtttctaacaatttttttttgcatcttctgcttggcagttaacttcatgaccttgaacaacctttctggctttcctgtaactcagtttccttcatttacctacctacttaaccagattgtacataaaaatacatagtatatatataaatggttatattaacagatagatcctttcaaacacacttatattggtggctttgttaatgaatattgcatttgtggcagatagacatgtttccttaaatgaaggttttcaaaactggcattgtaagtaaattttacatattatcagttgcttgcacccaaaactatttctactgtgaactggaatacatcttaagaaattattttaaaagatgtaaataactagtggtaaagtgatagagcacatcataactttcttcattatcataagtaatgtggctttgtccatatgttattctcatttgaattataattcttatttttattgtatgggggtttgcacacttttgtcctcaacttttcttgtttattttaaaaagggagtctcaggatttttcttctgaagttaaaatttaaccctaaagaaagatgccacagtagtttagtctgcttttctggagctctgaaccattgagggccagaactgacactataagcaggagcagcagtcccaagatgggattctaatatcaacctttgttttatctgattcactatgagtaagaggatacaatatgagtgaacagcaaacctgtgagaaacctacaagtataaaaccaatggtatttaattcaggtaataaaatagaattcttaaacaccctctaaattaaaaagccagaagatgcagttctaattacatgccttaactagaagtaggatatttgcagcttatcaagttttatgtaaatttgttcctttggcacaatttgcctatataagcagtattagttcagtataaaatgtttattagttattgaaactggctctagtgtaatttctgtgttttaatacatagtcccaagttttgtgggatccctagagagaactgtgtggtgtctatgttttgaataaacaggttttttgaataatagtaacttacatatctatagtctcttatctgaagcccttggggtcaaaagtagtttagaattttagattttagaacggtagtatgctactagtgctgtgtgctatgtgacattccaatagaatcttgggcaatggccaagcatgttgacatttcttagtgcttgaatgggataaagatcataaagagcatctttttcagctgaggtcaggttgggctgacagtgtgtttggttttccagagcgttttgcatattggaactgcagataagggattatggacctgtaatattaaatataatagctgacatgtattgtgtttattccaagccagacatggtactttacttgtattatctcatttaatctttgcaactctttgaagaaggtgatagtattaattttgttttacagatgaggaagagtttcagagaagttaagaaacttgcctaaggatacatacacctagtaagaaagtggtagagttacatctcaactaagtcgaattagacaccaaatctggtgtgcacaataactagttatcctcctcgtattcagtgtctctgatttgcagcccatagactcagtcttacatcaacataaagggaattaatacgaagggtatcaggtgatggagtatcaggcccaggggataattgggggaaagaatgagtctcagtagcaacacttctttgatagtctttcttggccatttccattagaataaatatacttctagtagcagtaagattcagatgagagagaatacttgagcttgtgttgctgttagctagggtaaagtggggtgtcacaaatccagcatgatggagcagtgttcctaaaggaaaattgattgctgtcagcaaaagatgtgattcacgtgagacagcacactcatgtaaaatgtccactgtatggatgattaattaattgcagatgaaactaacatttggatgaaaaccccagttagttttttaagtataatccattttaagtttaccacctgcttgataccagcaaaacagttaacttatcatcttgaatactcagattcctgtggcagttcagacactttctaggtcttggatctcagatctagaatcagtgagcttttttcttatttgtaatctgagagcaacagtacatctcccaatttacctagtgggcattgtgttagctaagatagcccaaagagcttctggaagttcataccctatgtgttcatatttctcatgctgattctgtgttgttcttgtataaccagcagatgcagtaggggagatcctgcataacttctgtggccaagtcataaggagccttgcagtgtccaccttattttcttggcatcttcactctaggggaagctactgccatgtaagaagtctgatcattatgctgtgaggaagtccaagctaaccacgtggagaaagatcaattcctggccagccagctgctattctagctctcccagctagtgtgccagacatgtaaattaccttggacatccccacccaaccgaaccattagttcatttcagtctaaagtgccatctgactgaaatggcatgaacgataccaagggacaactgcccagctgagcccagaccactcacagaaacacgaggggcaataatccacggtaataagtcactaggtttccccgtagtttgttatccaatagcagatatccagaaacaggtttgctgtgaagaagagagataatgtgttatattcctcaaatgaaggtgagcagctgttttattataattgctttgacaatccagaaagcaaggtctttctaatatcctcagaggtttcattacaatttgccattgtgatgaggatagtgatcatgctgtactctctggacagggatggagagtgttagtgattggccagcatccaagattgtcatcatttttccttagtgcaggagtttaaaacattctgccattttctcactcgtatttatattttcacaatgaatggggttttctctaataagattactgtcataaagtctcttatttaaaacttctgatggatcctcattgtggatgacagggcccatttctctgtttttgtagactgtccctctgtccagaaactacaggggaaataagatgtagattttgaaaaagtgacagcgagtcaaagaacagttggtcaaacagcttcccagcagttgggacaggctgccagagtgaatgtcaaagagaagttggttcttggatggttttacagaaaaacaagacaatgaaacaaagaaataagaaataagtaggaggcatgcagagggacaaaaatgaaggacttgatattaggacaccagagcaatcagtagtaggttggataggaggagttgagaagagggaggaggaagcaactaagggttggttggaacttcaacacttaatgggttcactccctcctgtctgtaattaattctagctttagttacttcattttctccttagaggaagataaagtgacctggactatcttctttatgttatagttgtttagaatcaaagggcattttcttaaagtctcttttcccaagtaattcttaagatttcttaagtgtcattgtctcttcaggtggagtcataaaatgcatctctatgaggggcaataaaatgcatggaggtgccttttatggctgttgctagcagaggactagaataagataatgatggtattttgcaaatagtgataaggagcaaattgcacattccaatgtcaatctgttctcaaaagagtatagttcaaagtttctacaaagctttttgaaagcttttcttttttgaaatgagtctctgatttctgtttttcctagctatacatagattttattttggggaaaattttaggtagtaacattatccttaatatttactgatttgctgtagaattttaaactggacaaatgaaagcccttgaggaagagaaatttatattctaacatagcgaaataaatatatgtcttgcaacttgaattgttgttaggaaattacttgtatgcctgagttcatgaattatttaatttaagattattttcctttttctaatttatcactggctaggtcctttaacaatcttttgatttattaagagtcattttccagaattagatttaaagctctattgttttcttatgattttcctatgaaaattgagtatgtctcctataaaagctatatttctcttgtttgacttatttcatttctctattatgaaaggcaatcattttaaaactgatgaaattttaaaaaattgacctaatctgaaaaaaccagcccatttcatgatccttcttcacttattggaaaagactatggagtcaggagttggggaatgtaccgacctccattaagaggtaaatgacttgcttgtgtctagaagcgtttgtgtcatttgcctctcagtgcttgctgcagttttaaggaaattgtcctcctattaaggttatgtatcagaatcacccttgaaactttttattaataaagattctctgtccccacaatgaggtttattaaatcagaatctccagggcactggtgtgctgaacgagtctcctaggtgatttgaattcgtaccccagtctgcatctgaaaactgccgcttttcaaagagaggcagacaggttgatggatgataggatccagtctgacacatggaaaagctacaaggagggagcatggaggaatccttcatttagggagacatgagtattgtgaatgatggtgtaatcactgctaaaaatttctcgggtttctaagaaagttttatgtcctcagttttcttgatggtgtctccagccaagctgtaatgcagtggttcccaactaggggcatcttggtctccaggggctatttgacaatggctggtcctatttttggttgtgataactaaggggatgccgctggcatctagtgattagaggccagggatgctgctgaacaccctcagtgcaaggggagccctgtgttagtcagaattctccagagaaacagaacatatatgatggcccagcttatgcggcagtcatgtgggagttttctcttactcagctttttgtcctcttttgatctccaattgattgggtgaggacctcccacattatggagggcaatctgctttacttagtctggagattcaaatgttaacctcatccaaaatatcctcacagacacacccagaagtacatttgaccaaatgtctacacaacctgtggcccagtcaagttgatatataaaattgaccatcacagccccttacaacaaagagttatcaggcccaaaatgtcagtagtatcaaggctgggaaaccctgatctagtgaagtgcagtgaaattctcaaaataaaaatattctaggggccagcattgaaaaggatgtggcagggccaggtaggagagcattagagatggcctgtgtggaccttgaggaagccagatgagataaagaggaggagagggcatgaacataggataaaagctcgagacaggaagagatggggttaaaatgaacatcaggtacttgaaaagagggatgttcatcaggtgttatttttcctagcagtgttatgtaaaatacgagtactatctgaaagtctgaaaaaggtagggccaatttaacatcagctttaagatagtaaatctctattctgtaagatgtaatggtagtttttaagccttgaaaattggaaatgttagacaatggtagcatatgtgagccagagagaatttgatggtaaatttgtagtacagaactttagacttgtttttaccaggaagaagcatcagagaaacagtgagagtaatcagcgcatatttgttgtatttccgaggctggtaatggagctaaagtgtgggggcagagctttttgtttgggaaagtgtggaaatggggctggtcaatgcagatgaaggggtgctatgggaaccttatgatgtaaaatacactctctcattgtcttcacaagtgtagctctaattgcctgacctatgtgcagatttgttgttcagaacaaatggggttaccataagtatggaaaatggttcctggtctacagcgaattggagagactagagaggcaagccagtgctcttaaatagcagtgacccatctaagttcatttttcatcacccttctggtaaatacttcctaattttctctaggggatgtgctttccccatgtttgatctgtttttttctgagaggtgtttggttcatcctggttgtagggttgggtttgtgatataggcatagcctctcagaggcatttggccataagtcttatctgggtatgggctcatgaccccaggtcaatctagtcagatctgctgatgttaattctgaggctcttttctttccttacttttgtatttggaggtgtaaggatgtaatcccacgttcttggtcataatcttgtcatactatagaaagggactttttcaaaatgtagttaattcaaggaagaccagagttgagagaccttatatcatttgtgctcctggatgaagctgtacctgaagctaggttgtcccagaattctgttagtaaactattaaatttcttttttggttatactagtttgtgttgtttctttcactaatgactgaacaaattactaaaagatacactgaattattaggagaaactgtccaattagtaagtgatatagccaactaataactaattaattaatgtttcatactccagtatttgggctctgtgtatatattggtgatattcttccattcttgtttgtttgtgttttggagagtttgacaaaaatgcataggctatctctggtaatgcttggtttaaagcatatttcatattcagaaagatgttgtatttgagaagcgacgtggtaattggttttgagagtatacatcttagacaattaaatggttacattgcttccttccttggtttaaaaaaaaaaaaagaaatccaagggtattccagttgtataaatagggacaacacagtttatgctatttgtaattacagataccactcaaaagaattgattccgtttacttttgtattagtgtactgtggaaagtcgttaattataatgtctgttcttatccaacaacatgcaataagtaaagatgaaaatatagagattattagtttgaataactggttgcatgccatccggttttatatgattgctgaaatgcaaaacaaacaacccctccccccgaagaaaacaacccaccgttcttaaataagacatttgtgacataacaaattagaatctaggagaaggaaaatattttcccagtatctaaagccattgaatcaaaataatcgtgtagatcacactttagttcagatataacctaaataaattctctagccagggcacccatctgtcaaaaaataaaactctggccctcatttaaaatggctcctttagactgaggtcatctagctgtatctaaattggacatgaaatgtcaatttcataccttatagtggcacatttcatattgctctacttaaggttatgtcagctttacccataaaatgcaagtgatttaggtcttattctaaatgaactaaccagatacatcagcaatgggcactgccttgccactgcagaaaaagggaatgtgtgaagggaagacagaaaccacttattctgtttcttaactctggaagtataggtattccaggttgggatgtcttgtctatattttcattccttgtgaatgataatttgggggtggggggattagaaagatgctttattcaaaatgaattgtattgcctgcaggcgattcacttgcttaagttatatttgtgagttattgtatgtaactttatcacattggaaagtttatgaaccttgtgtagaaaaaagattgcattttgggagctatgcacatcatggctttttcacaagtgacagaaaagtgctgcagatgatttaagcaggaagaaatgaatttttcgaaagattttgagtccagaagggagatagggcagtcagtcttggaagatgaaaaggacaaagccaaagcgggccaggcaggcaagggagtagtgttgtgaacgccctaccccacccctactgcatctgagtgttgcaactgcctgtgttgccactatgtaaacactgctccttaatatctgcttccttggatccgaattcagagccctggggacagtgcatctcattggctgagcatgtatcagccattggtaaccaagctgcaaagaggctgggaaagtaagtagtcggctctttcagcttctagctggaatgtgatcacctcccaatattcttcttcttctttttttttttttttttcgagacggagtctcgctctgttgctcaggctgaagtgcagtggcacgatctcagctcactgcaacctccacttcccgggttcaagtgattctcctgcctcagctccctagttactgggactacaggcgcccgccatcacgcctggctaatttttgtgtttttttactagggacggggtttcaccatgttggccaggctggtcttgaactcctgacctcaagtgatccacctgccttggcctcccaaagtgccgggattacaggtgtgagctaccgtgcccagccccagtatgtcttcttatagtggggggtatctaaaaacaggaagaagtttcagatgcttggcagctgacatggctaattttaggtcaacttgactgtatcatggggtgcctggataaaacattgtttctgggtgtttctgtgaaggtgtgttaggttgagatcaccactagaataaatggacttagtaaagcagattgtgagtggtcatcatccaattcactgagggcatgaatagaacaaaaataccgaaggggaaaaattaagaatttgtccctttctcttcctgcctgctggttgagctgggacattggtcctctcctgccctggaactggtatttataccatttcctggttatcaggccttcagacttgaactggaattacaccattagctcttctctggatctccagcttatagatggcagattttggaacttctcagtctccataatcatatgagccaattctttgtaataaattttcttctctctctctctctctgcctatctatccatctagttatctggatatatcgcctatgggttttctttctctggagagctctgactaatagagtagccaaagcaaagacagtttgtatgtgtatggttttatggggagtggattttcaggaaagcaggaaaaagattttttccagggcacttgggtagtgcatcttttttcctctaacaaatgggggagcatgtggccttctgagtactgggtttgcttaatgaatcaggagagccagtgtttataaatattcctttaaatggcagagcgtagatcctggtttgtagtccccttagtatatttgtaatgttttcatcatacccctaggccaaagaaaatactcaacattaagtagttttattcattaggtaggtaggttgaaacaaatgaataagaatttatgtactaacgtaatttgaaaaacatatatatcatttgaaaaaacacacaaattgaaataaaatatttttttcttaaataaccactattgcttactaatgggatatatcctcctgttgggcacagaatgacttcacatacattggaattagattggacactgctacctgattcccatccacattgattttcatgacgcacattttattacagcaatggctatgaacccagctttgcaaagatataacataatgaaaaggaatgtaatgcaatcaaatattgaaactgccaactacctcgagctatcctgacagttgagcatagcttgggagtggtagacatagattatcactgaaattctaatgtgagcctgatggcaacttgagttgaagggcattcttgcaagactgcttggttggggagtgtcacaccagctggatgtttccagaaccaagggcctgggaaaaactatgccagtgtgcacagtgcacactcttcctcagtgtagccactctgcttctgatgtgttttgttgtctaaatcagtcagcaacctatcacagatgtgtgcatcttttcctaccaatccacaaaacccacctgatacggtttgtctgtgtacccacccaaatttaatcttgaattgtaatccctataattcccacctgtcatggggggcacccagtgggaggtgattgaatcatggacacaggtctttactgtgccgttcttgtcatagcaaatgcgtctcacaggatctgatggctttataaagaggagttcccctgcacaagccctcttgcctgccgccatgtaagatgtgcctttgcttctcctttgccttccaccatgcttgtgaggactccccagccatgtggaactgagagtccattaaacctctttttctttataaattacccagcctcaggtatgtctttattagcagtgtgagaacagactaatacaccacctgaaataatgtaccccttaaaatccttatttatggattgatgagaaaacagagctttcattttatatgattaacagaagataagtgcctctgttgcccagatcagactgtcttagttcattcaggctgctataacaagttaccattttctgggtagctcctaaacaacagaaatttatttcttacaattctagggtcttggaagtccaagatcacggcaacctcagacacttttggtgagggcccacttcctggttcatagatgggccttcttgctatgttctcacatgggtataggaggtaacagagctctctgcagcctcttttataagggcgctaaccccattcatgtcctaattacctcccccaaagccccaactcctaatagcatcaccttgggtattaggatttcaagatatgaattttgggggaacataaacattcagaccatagcataggccaattaagaactaggtatatgtaaaagcatggctccttttttggtacaaagctggtgtatgcctcaaaatttatattttgcactcagaaaaattcttccttttattccctgaactgcttgttcatgtgatctctacttctgtatgtccaggtctttgatatgtgtatgagttgactgtttcattgtgtcggaacatcttttgattgtgtcaagagttccagcttcttttctttaaagatcctgttttataatctgccagcctgaccacactcagcatacagtcttcaaagttacaggttatgtgaaactttcaaatgagatattacttactcctgttcttcagctggaatatcagttgctgggggagctggagaaacaattcccaaaatgaagagcaccttagcatttctacaatgttgtcattgcagggtattgtgataggcagaatgctggccctgccccaaagatgccagtgtcctaatctctagaacctctgaatatgctacctcacatggcaaaagggactctgccaatatgatgaaggtaaggatcttaaaatgaggaaaaaattctggattatcctagtggacctaatattttataagtgtacttgtaaatgaaagagaggggcaggagttgtgattatgtgattgctggctttgaagatgaaagaggaccataagccaaggatcaaggtcagtccctagaaactggaaaagccaagaaaacagactctctgatagaccctccaaaaggaacaggaaggaagccctgcccagtcttaattgtagcccagtgagacccattttagacttctgatttccagaactgtaagatagtaaatgtatattgctttaaattactacatttgtggcaatttgtcacatcagtagtaggaaatgaatacagctataaagtggaagaaaccatagaaagttcactgagccttttgagattaatctttaactcatattctaaaatcatatagctccctgagtgtcaaactgataactacataatcacactttcactgttctcaggtttactacaagcagaattaccccatactggtgttcaggcagatgaattctcactatgaaatactttttaattggcgttcttatgattgcctccaaaatgtttaaaccttttgacagttgcatccattttatgaatccatcttcagtaataaagattgaaatgctctaaaccaccaaaaattagtggcttaatcagaaactgagggtggttctataaatccaaagctgctggtcattagacctcactaccatcattatgtatttcttcatcctgatgcatctcacattcattttttgacacgttaatgatttctgtcgtaggcatattaactgtccacatgtaaatgtgatggacactgctttggtttagcatggggctatttcgattggtcatacagccaaagaaggaagtaaaggatgtaaacagtgtgggtgcttatatttttttccaatatttgtggaagcatctgtttctacatatgactggcacaaatgatatctttttgtaaaatatttcataatttctccaaaatataccagctttctggttttgtttttagagctagagactttgtctgctctcctgactttttgatattctttctttcctttttttttctttcttttttttttaaagatggcatctcattctgtcgcccaggctggagtgcaatggcatgatctcagctcactgcaacctcacctcccaggttcaagagattctcctgcctcagcctccccaatagctgggattacaggtgcccgccatcatgcctggctaattttgtatttttagtagagatgggctggtctcgacgtcctgactgcaagtgatctgcccgcctcggcctcccaaactgctgggattagaggcgcaagccactgtgcctggctgatatgctttcatttttcactccctttttaatcttcccctccattaccagttaacaaactactacagctgcctctgcaaatgatagaagaacaaaaattaggaggagagggggctggaggaggagaagaaagaagcagagaaggagaaggacttcatagaaactacggctgctttcaggcatataatgtgagatcttgagagagaattaaggagtgaatttccacgtaactttcaaagattgtaaataggctgcctctattttttgcaattgccaggcaatgacagtgtactttacttctactctcctctgaaggagcaaaatgagtgctctatggccttaacctctatttctctcttaactggattcaaacgtatgtcatgctttgagccttcattacgtaagcgatttttctcaaggtcactgggagcaccacgttcactgcctctggatggttcactgtactgccgtgcagccttgctgaccatttcatgatttggggttcatgttcattttatagactggatttttttctgttttacgtttcccattttctttgttacttagaattaaccatgaccagatcaattaataaaatagttcaggttgtcttattctatttgtgcatttggtttgcagttaccttcacaaatattctggtggctaatgaagttaaaccaaagtttgtcaatctgattttacataagctgtgtgccaaaactgtgttaggttcaataatgctcattttcttgtttaattttcacaacaactaagaatattatcagattcatattctccttagataattaataattaatcacattattattctcctgagaaggaggtgatactattctcgatttagacataaagaatcttaggctcagagaatcaccagcagattgtaattttgagcctagatcatcaatgtctaaattcttgctcctcttattataccattctactaatttatcaatgataaatatttgttaaatgcatgttgtgtgctaggcattgcaccctgttctttatttacaaacatatgagttattattatctctgatttgtagatgaagaaattgagtttagagttaaatgattgcccaggattatgttgttacaagtgcagaatcagtaatcaaattgctgtgctgtgtcctccagggcctgagttcctacattgccatgagccattaaaggtaagatgctaattaaaggtatccatgactaattttaatggctaacacaagtttggtgaaattgatttaccataatattttggttactttttagggctactcagatacacatacttgaactgtaacagcaaatagtgagaggggaagtaaagattctgagcctcctttctgggtttacagcaatattttgaactaagaagatgaagtagaattagacatgagcaaagctccatccctttcttctgcaggtgagaaagaaatagagggtgtaggaggtaagcatacctacctagtaagccttcatgatttaggtatctggagcaggtgggactggagcaattgccatgaagttcacaattttagtgtggcctgtgatctgtttctttggctacagcttacatatcaggcctggggatttttctggattctgaaggttctagcttccagccttgaaattattctcctacttgtaggtcagtaaaacaagcgtttctttacttgaaagttttaagtcgacagttgccatgataaatcactcccactgatagtgttttagactttgttggttctaccttacgggattttcatagagtttctaaaagagaaagacaagcactagagtgaagaattgttcttattgtggaagaatcatcaaccttggctggacacacagatcaaggggttcagggatgggtggcaaaggatcattgagagggttacatgtgacccttgcctaactatagtagttaattcaactctgcctacacaatgacacggattaccgaggatatgacttgtattatactcatccctctgaccccacatcctaatgttaataatgattcttaaacctggaattgagaactcaaatataaaccagtgcccagcacatagcaagtcatcaattaagtttattgaattaaattaaatattggaattgtatctgtcaaagccatatcagctctaagcttcttaagagaaaaatctgcccagaatttctcaggagggatttctcaacatcgaagctgtcctgttcatattggatttattgtacttacataaacaggaatacacgagcagggaagatcagatcagttaccacaataagggttttgtaccatgatatacatcattttcgctcccctaggaaagcactgctgatgaaaacaattttggagggaggtggtctcaacagagtagatgttcaggtggaggttatctctggtgctctgggcttcttattcataattttctcttatgaaagagagtggttttcaacttcacaattcctttgctcatttggaaatatagtagcagaaagatgaagagagtttgtgacccacaactaaagtctgtgttctcttgtcacttcatcaaattagttctggtggcatttggttcccccccagaaataaatcactgttaaatgattctttataaagcagtccacacatttatcataccacagtgatctgaacccatttagggaattataagctacagttggtcatgttgcaggcctagcaactctggccttgtcacattgcatctctctccactccctgtgctaccactaatccttcaggactgagattcaaggctttgctagtaagaggcttggaaataatcatataaaacataatagtgtggcaaggtgagatcgagcttttaatttttttaagttcacagagagcaagaagacagataggaaaggaccggcagattgggaaaaatcaggaataagatgaaatatcctcagaactttagcttttatgattccacctcacattcagtttaattatgaaatttactggcagtgacaattggcttttggcataaattaatcatgccaagcattatacatgaaatgaaatttcaatcctatttgttgaacattttctaagagcttggcaatcttgcccagcactttacgtagggtttctccttatctaccttatgaaatatgttattattattcccacttttaatatgagaatatttggggattagaaggcttaagtaatttgacaaaggtcatatgggctagcataatagactagaaaacaaactcaggatgctgtaattactacactggaatcattcttagttttttttttttaaatgaagttggcattagttttgttttttaatctttaatacttttatctgagaattgataattaaccattttaagaaaatagttacataaatttagaaatcatttggaaaacaggtaaaattgctacattatttcaatttattttatttttaaaataaatgatattttttatctatatttgagggctatatgagaacctaagacttctattgatgttaattattgacttttatttactgtagttttagtgaataatttaattgacttctattaattcagtcatcatatgctaaacctagagtaactgctgttaatatttttttttttagctactacaaattgaagtatttttgattagagtaaaatttatttctaaaggtaacctgagtaatatctctatgttgtagatagatattactatctatagtaatatctatgcatatagtatctatgtagtagctttccaatttattttgctattatctaaaataagaaatacattttatattgttccagtaaatgcacacatataaacacatatatatgaaattgatacttcataaaatattagttacccttattataatcagtgctcacttgatattttacattttatcccattgtaaaatagatactggtcatgactcacagtattgatttcataactccctaatggttgtagcctgcagtttatcatttgttcaaatgtagtgtggtgggaaagaaagatgatatgactcttcagacagagaggtctggtccctaccctgatatgtgtcagttatatgtcaccttacctataaaatggtgattatcagtacttctcaggggagttgtaaagcctggtacctagtagataattagtaaatatcagtttcttttgtctttagagctcacacttcattccatagttttttgttgttgttttgttttgtttttttgagacggaggctcactctgtcgcccaggctggagtgcagtcgtgatcttggctcattgcaacctctgcctcctgggttcaagcgattctcctgcctcagcctcccgagtagctggaactataggcactcaccaccatgcccagctaatttttgtatttttagtagagatggggtttcatcatattggccaggatggtcttgatctcttgacctcgtgatccacccaccttggcctcccaaagtgctgggattataggagtgagccactgtgcctggcctcattccatagtattatagaaaatgtcgaactgtttaagcattccagcactttattttttaattgttattatttttctaccctcagcatgcatcagaggagcattccagccctttagtttggattttcttgctatttctgattttaactatgtgtgttcttcatatcttggactaaaaaataaaaacaaattaaaaatagcaaaaaaaaaaatttgcagtaattttaacagaccaacattaagtactctggaagccagaccagaagctaggggctcgttaatttttatgtatcatcaatggaaatgacttttatttgttaattattttttatgaccacctattgtaacatcttccaacacatatttccccctctttcccgtcctccactctttaaccttccttgcccattttttgtagagatgccagtgaggtctttctcagtcagtgcttcaatcccattatttcccatctcaacaggcttcactggctcaccattatctttcatattagtcacaggctcctcagcctgaattgaggcctttatgacacaattctagtctacctttggagatgtgcttcctttcagtgtcctctctgtatttcatacttactgctttgatcagacaagatggcctgtctttttccaaatggatctcacaatttccaggctctgtgtatttgcttatgttgtatcctctacctagaagtcttttctcctggtccatctgtcctcattaaaaactccactcctgttttcaaattccttgtctgtttcatcgtgactcttctaattgattctctttcactcccacactacttctattgatgttgatttctctgaagctggctcctagtgccttttttcttcttaaggcatgatagtgtgtctcaagttggaatgatttcatggctcccatatggttgattggttgtgggactttatcgctaatgataattcagaaaatagtagtaggactaattgcaattctgcagatttcaccttaaacatatgctgcttcttgggctgtggaagttggacacattgagataagattattcagaaaaacagcaaggccgggcgcagtggctccctcccataatctcagcactttgggaggcctaggtgagagggtcgcttgagcccaggagtttgagagtagcctgggcattataggggtaccctgtctctacagaaaataaaaaaaaaaaattagccttggtggtgtgtgcctgtagtcccagctactcagatggccggggtagaaatcacttgagctcagaagacacaggttgcagtgagctgagattgcaccactgcacttcagcctgggtgacagagcgagcccctgtctcaaaaaaaaaaagaaaagaaaagaaaaaaatattagtaggtctaactgtaattttctaacttctggttttaaatatacactgtttcttgggcagtgacagtagggtaaaattacccagtttgtgtaaatcttatgaggcttgataaatggacttaataattatcagatgacgaaattaaatgagtcggtgaatgttaatgcgtccctccttccatgtaactagatgccttgggacagttccaatatgtggcatttatattgtattatgatgtgttaataatgtggatcagagacaagcaaaagtcaaggataaatgtaatttcctgtgaaatgtatatttaatactttttaacatttagcggaattacctttggatgtcaattgaacattacatccccttactaccgtgactgtgtgtgtgtgtgtgtgtgtgtgtgtgttgggggggtggtgtctaaggagtaaatctattctcttactgcaatttcaaacactgaagtattataaactttctttaattgtatcgagttttatatattttgttgattctaagagtttttgtgtatgtgtgtgatatcagtgaatcaggcaaatttcccagtgtgtgaagcttttgggtcagctattaggttattacatcatttcagaaatgctccgtctgccttctggtggccttcagatttggccaagtagtggagtagtgcaaagactgctaatattgtagaaatcccgtgaccatacgcagtggtttttattttgttctaaggggtacacacttccatttgtctgttttcatgcggagcacatttatatgagggtaagttcaatggcaacttttagtctgtagagggatacgttgagaaatatgttactgaccataaattaccaatttgagatgaatgcatacttcagaggccccactagctcacatttttactgctgtcccctaaaagcaccttcaggtttatatgctgaagatggagaccttcatagttagaaaattgcattccctcaggccacaggaaatattgcttgacattctgtaacactatttgatgttcttaaaacagcatgctatgtagatactactctaggtcatgtctaattttttaatctgtatttataaatactatgaagcttgtggtttttaagaatagtaatgtttacatttatataatttgatgcaatgacttttccctgtaatataaaattaatttaatgtttagtataaaggaaataaccaggttgtatagttgtaggttgtgcaactacaggttgtgtagttgcaggttgtgtagttgacttgtgtattttcacttcctcatactgacaacataaccagaggcctgaccaatgctggtgaaataaccaaaaaggttgtcaggcagacctttgcgttttaatgcaaattcaacagggaatggggtgggcatagcttttttttttttttctgtattatatcaagtaagctgaatatatgcaaggttagagtttaaatgtaatgattagttttattcatatacatttaaaatctaatattctacaagatgcttagcaccatacttgacacattgtgagcattcagtaaactgatgttatcctttaagaagcatttaccacagaggttaagagcatatgctctagagcaaagttgcctaaactatttctgcctctgtttcatcatttctaatatagggatagatcatttagttcatagaacactgttaaatccatataaagcatctataacagtgtttttaataagtaaaaaaaagtcagctaaatattagttgtttattaattgtaatatatcctaaagcaacttatttcttaacgtagacttctgcacattcttggaaaattaatatctctttttttccttgcaatttttttggatatttgaaactataagtatcttcacccagttgtaggacatatgtttttctattttcttcccccttgttggagaaatctatttctacgggacaagctggttatttgtctacagatcctcccctggggattctgtagcagctacttcaaagctatctcagcttgcacttaatcatttgaaacatcagataacttgcttgttcattttatgcatgttttcttattgaggaaattagtcaacctaaaatgagcaccagaagattatttttcttggttttactcttaaagtcattctcaagcatgttatcttggaagagcagggcactctcctgcagcttttaaggatgactgaactggagaacattctgtttaaccacaaaactcatgttccctctgtttaatttcttaaagcttgccctcccttcaatgcaattaccatttttcttacacattaagaggacaaaatttgttggcttcctctttgggggaggatgtttatttatttagaagatactttttgagttcctactggtccaccgggaactatcgtaagtaagttgaggatacagggatgagcaaaatggacaaattctttgttctcatggaccccacaggagaagaaagacaatagctagtaagcaagtaatacatttttttagacagctaatttttgtatttttagtagagatggggttttgccatgttggccgggctggtctggaactcctgacctcaagtgatccgcccacctcagcctcccaaagtgccgggattacaggcatgagccacttcgcctggccaacaagtaaatatttttgactatgtggaaatatgatgaagaaaatgatgaataggaaaatgggactaagaggcaagaagggcgaagcatctatgaggaagtggtatgtggacagagatttgaatgctgacagggaggcagctaagagactctctgaacaaagaagtatccaggcagaaggaacagcatgggccagggctctggggccaaaacaagctcagtctggctgagaaagggaataaatgactgaacacatttctgtagccttctatgttccaggtgctatccaaggtgcttgggatacgtcagccaacatatttgcaatgttttgcatagttgtcctctccaaaactcatgtcgaaatttaatccccagtgtagcagaattgagaattggggcctttaagaggtgattagaccctgagggatctgccctcaagaatggattcatccactcatggattaatggattaatgactaatggactaatgagttgtcatgaaagtgggactggtggctttataagaagaggaaaacagacctgagctaggacactcagtcatgtgacagcctgtgccaccttgggaccctgctgagagtccccaccagcaagaaggccctcaccagatgtggcttctttattttggacttctcagccttcataactgtaagaaataaatttcttttctttatgaattacccagtttcagtttattttgttaacagcaacaggctaagacaataatgcatgattttttctaagtaaattatgtacaatattaactgatcagtgttttaaaaaaatgtttgtatgcagggaggtaagagtgcaggaataggtgggctacagtgtaaaacactgaggtcaaggtaggtctcatagagcaggtggcatttaaacaaagtattgaaggagacggggcaagtttgtcagatgggtatgtgggagaaggaattaccaggcacaggtaatagctagtacaaaagccgtaaggtagcagtaggcccagcttgttccaagtgcctcaagaaagcctctgtaactggaacagagtgagtgagatgagtgaggcggagaagaggttagagaagtgataagaggtggcatcaggccagtctttgtaaaccactgtcaggacttccgtttgattgaaacgaggtgccgtctggtaggtagctttggggtctagactggggaggggtggagcaaagttaggagcagggtgacttgttagcagaataatggaataagccatgagccacactctggttgctcttacagggccgtggtagagatgatgggactttgtcagattctgaatatatttagaaggcttcagaagtgaagtatgagagaaagaagaatccaggatgtgactccaagtgttttgtcctgaaaaaatagaagattgagatgggaaagactagtgctggaacaggattggatgaggtgaggagtggctgtgtaaagcaggagacacccaccgttcccagggcgtagttctgtatctgccttcctgagttaggcttggcagtacgactggctctggccggtgggtcatgtcgatgtgagacaaaagcagggtacggaaatgtactcccagatcgggctcagcctcttgtgatgcagtcattttcatgagaagagctttcctggggcagacgttgccctcttagcctggaccccaagtgaatgcaagtgacacagagccaccccagctaagcccagctcatcccacatttggaaggagggctgcccatggagcctgctttagattaccagaccctacagaatcaagagaattaatagctactgttgtaagccaatgagtttggaggtggtctgttatgcagaagttttgtggcaatagctcagtaatagagaatccagggagtgaagtgaaatagggagttggatataggagtctggagttgagaagaagtcttggttggagacaaaaatgtaagcgtcattggcataccaatggtatttaaaacctcaaggcaaatgagatcaccatgggagtgaatgtagtagagagggtgaccgaagattgcatgactacatcattacaatgtctggaagaagaggagcaacccatgaggaggaaggaaaatgccctacaaatgaaatggatgaaaacaatatctaggaggaggaagtgacaaatgatgtcaaaggcaactgccaagaattggtcattggatgtggtaacctggggagaattgttgactttgataaatacagttttatgggagtgttggaggtgcaagcctgattagagtgattttaaacacgaatataggcggagagcaactggagatagagagcaaagtaactttttgaggagtttgtgggaaggagacagaaatgaaatgaaacaatggcctcctcacaaaaggagcgcgaaaccatggtaagggtgtactttattctgagcggggaggtagttgaagcgtttaaataatgacctatttgtcttttagatattgctctgactgctgtatagagaatggcgtggggtgaaagggagcagaacagttataaggctatttctgtttcctaggtgagagagtgtgttggcttcagctgtagccctggaaatgtggaaagtcatgtgtaaatttcacatggggtaatggtattaggtagacagcagtgtgggatctttagcttaaggaacttaaaaaagtgtttgtgatcaaatgaaaaatcacaaatgtatatgagaattatgttttgtaacttctctttagctctaccttatcttatataaatcatactggtttgaagcaatatatattggttactttattaaaatttacattctgttatttttttaaataattcctgttgtctatgataaaatggatatgactggccaggcatggtgtctgacgcctgtaatcccagcaatttaggaggccaaggcaggaggatcacttgaggtcaagagttcgagaccagcatggccaacatggtgaaaccccgtctctacaaaaaatacaaacattaaccggatgtggtggtgggcgcctgtaatccccagctactcatgaagctgaggcaggagaattgcttgaacccaggaggtggagattgcagtgagccagtcgtgcctgcactccagcctgggtgacaaagtgacactgtctcaaaaaaaaaaaaaataaaagtggatatggtaatttttctcctttccaaattatattttgttccatcctggatcattcagtctacactggcgtatttcgctcaagtgacattagagatggtttctggcataatatccttgtctgagtctgtgtgcaaaataacttttttaaaaagtggaataagttctatgatctgtagttgggatagggattaaacaacaacagcaaaacagacttttacttccttagatctcagatttatatgtatagagaattggttttacacaaatagtgaataaagtattttgccaagtgtgctttcagtagagacttgaatgattgtgatctgttttgctcttattccacgttcagaggttcccatgggaaccactcccaattcgtgggaagagtggaatttaacaaacaatacagaaaagccatttaatcatcctctgtgtgatccacaaaagtgccagaaatacggaggaaatgaaatcactagaatctctatctgtatgggcctgcccagagaaaaaagtgctgctcatggtaaatagatttgatagatggcagaaaaacaccagtgtcctaaatctgacagtaacaaaaaacctctcccatcatccatctccttcagataccttttcaaaatttgttaagtgttttgtgtcctagagtttggcatcttgccattttaatttaactatttttcccctgaaagatttgtttccagaaaaagcttgggatcataatacagtaaaccttacacataatcttctcattatgttcagaaagctaattttaaacctaattttcccatctctgtctctctctattccagtgcttacctgcctgcattaattaattcctgtgcagcaatgaaaatttgactcagttacctgacctcttaccttctgattgcagaggctctgtctcttacaggggtgtgggacgcctggtgccacaggacatgtgaacacagattatccgtacctgggaggtgactttggtgagatcggagacattggagtcccccaggagcagctcctcagcagattggggataagaacagagggcacctacaacaatctatgtattacagaacacagctctttttcttttgcgaacacagctgtttttcttttgcctgacttgactgaaaactgtttttaagtgaattaagtgttttaagtgaattaggtgtttcagctatgtcgccagtgggcactgaatcctaaaacagtgatctggaagggtcttggtgaccatgctatccaagcaccatgagatttggacctccaagttgggttcatcttctcactctccccgtgctctctactgtgaaaccacattggtcttcgcttcctccaacacagctagctcttgtctgcaccagagtctttgaactgtggtgcgttttacgtgaaatacctccaaatgattcttgttcatccttaagatctcagaatagatgtcatttcctcagaaagcaccaccttcttgaccctccagcctacaggaggattccctggactgtgttgtcatagcacctttgcttttccatcaaaatatttaacatagttcataaattgtttcatagatgagggggtggttagctcgggttgctttttctcttctccagtaagagatttcagaatcactccccttagaatcatttatatgaggttttcccctgagggcaggccagtggcctcactgcttcagaagggggtgtaatcagggtgaagagcaaaaatgcttggtatctttgagggaaaagaaatgaagttttggagagctggtaggtgccagagccgttcctgcctcagtgcttccataaccagctggggacttaggaggtggctgtttgtgggattcaaaaaacggaaccatgggaaccttggaagcccaagtgctgggcgtcttcgatgagcttagcattcagaagagaaattgcgcttcataggccatgtggggtctgtgcataaacctgtatacagcagagttcattgcagcaatggtcccgcgccttcctcagcagcgtcctcaagcagcgccaccgtgtggcagcagtaagcaatggcagtgatcggattcctgtccactccctggtgtggatgtcctcggcggacttcctgtccattacgcatgtgggacatcaagagataaatcggaaaaataagaaatacaactgtatatgaagcccggtttggagaggcatttgtttgcataagtctgtaagatccgttgtagaccctcggtaaatgtttgttttggagatgaggaaatggaggcagagagaaggcaagtcatttatcacagacagcgttaactctgggcagagttaggataagaatatgtgaatcttctggccccagttttggtagttctgcagttgaaagataccatgaagaaggatgatgtgtattaagagaccatgatccgatcactctttatgagattactaagagctatggattgctagggctattcctggctatttggggagagggaagtctgaccctcttggatgcttattttatctctggcaaccattttggggtcattaatatttctcatctgcatgtctgtacctcttccttccagttttcctaatgaccttcttcctttttgcctgcctccttgcatttccgtttcgttggtttaccaaatagatttcattgtgagatatgtgtgtcattgagtcaaatgtatcttcactaaaagagaagttctggttcctgttctgaaatttctgtcttacacatttaaaaatggaagaagatatttaaaagtaaaataaattaaataagcacacattaatataatgagattacataagacctggtggataatatgtgagactgggttgagattgatgagtgatggcttcttagaggagaaagattttaaagatatgcgatatgaaagtagagggaggaggtgtgcactccgacgagaaatgagacaggtggggaagtccagtgtacatgtgtttacggggttagtgagaagagagttggcaaaagtgtatgggattattcagaacaatctgaggaaaagatatctggcttagggaaggagttcctggagtcaatggagacttaagctgttaaaggaaaataaaagtgaaaaaaatgaaaaaaactttggagtagtttttgggctcaaaatctcactttactgttactatctgggtgactttggacaaggtatttaagatatgaatgtgttttctcatctacaaaaatgtgcttttgtgaaaatcaagtaaaatgtcctatgagatgccctaaaacaatactggcctagaggaggtgttcaataaatgtaacttttacactttataccaatttcaaattctcatcactaagttatagtttcaaatgaatgttttcagtttatcttgatgttgctcctgacttcaaaattttctgtttggattttcttagaaattaataatctttcacacatagctatcaaataaatcattgttttcatttaagaaacatggataaattggcacacacacaaaatcattctcagaaatctatcaaaaccaattaaaggaaccccaaattaggaaggacaattgcatttgtcatgaaattagagtggagcctcagcctcaaaccctaaattacaaagactagtttttgaattcaatttaatagaagcttccaggatttcatacatatgttctttaattttgcatatactgcatatatgggaaatgagaatgcttgaaggggcttttaaaccctggtaattaggacagggtggcaaagtgacacatcaaagtttatgttccagaaataaaaaagaaacttgtgacaaatgacttacaaagggcgaattttttccccaaaagtattaatgtaagaagtttagatatgtttctaaaagtctaccatccctcattatttgtccatcattatttcagtacaaacatacccaatgtttcataaaatatatttcattaataattaagacagacaagctttgatttaacaatttcttaccatatgaatgtggttgtggtctcaaccactggtaaaagaattatgggggacacattcagctgctgcaataaagacaaccattgtaaatgcttacctcttagatgaaaatggttgggccggatgtcctcctattgtttgctcttccacatctgaaaagaacgtagactaaatggagtgaatcctcactgatacatggaagtgaatatgtccacattggcagcattcataaacagcagcaggtttccttaatatgagaatcagagtagttacagcatagatgagtttttgagcctgcatagaaaaagtccagaaaacatgcagcacgcactgctggtgagcattaactcactcttgtcatttgggaaagagaacccattgtttctagatcttcaatttctgcagaaaagcatggagtctgttactcttcatttttttgttttgtttgttttgtttttggaagagtgaaatctccagctttaaaaatgttggcaacaaatacaacattctttttaaagcatagtcagtgtaagcatcgttggtgggctagacaggacatacctgtgagccagatttgactcacaggctttcagtttgcagtctctgaggtctagtgtatgaagttggaatcccgagaggcagcgagtgggagaaaatgaaggctcagaacaagtcagacctcttgtagcaggcctataacttcttcctggagcaccttgactctcttagcaccatacaggatctgatctgagagagagttgtgtaagattgatgctccagaattatactgtatacttttgaccagaatattttcattttcagtatgaacacattgctctcttaagtattttttgcatttgtaaaagaaaataataagccccaacatatccctgaagcttacaatatctgtgccccaaactcttccttatgaactttcttaatattttaacaatatcaaaacagaaaaaaaattgttaggcataaattatctacttactctgacctatatcgggttctttttcaagcttttcaaaaggtgacacaaaagccagttcaacctgaatattggaaaagaattgcaggggtctctgagcattgggaaaggatacaaaaggcatcagaagtttggctttgagacagttgccatgaaaggtatctcattttcctgccctggagattttatattaaatggattatctgtctgtcaagcattttgagcattccccttcactgctttccctgaggactattgcagcatcttaccgtgtgaggtgggccatatttttttttgcagatgatttatagaatatgagatatataagcagccgttaacacatctagttttatttttaaagttatgtttgaatggattatgtttgtcccacaatcattttttaatctgaataataaggtcaatttgacacagctctttttttttttttaacatttagtttaatcctttaacaaaccttgccctcatttctgtttaaccttggaccacctgctttggctggttatgtaatttgcaaattagaaaatgactatttcttttttcttgttattggactccaaaactcacccaaattctttttctttgctttgtgtttcctctctgtcttcctaatttcttatgcctgtattaataaaatggcttgagagataatagtctagttaaatgcatagtttcctaatttgcttatggaaaagctaaagtagactggaaagaacatgttactaaattataattttaaattttttatcattgaatgtcagtctcactgtgatccttttatgactctataaatatgctttcttttgaatgctggaggtggaaggcaggttggcggtcacctggactaaaaccatcgttttactgaaaaagcaattgtgaactaaataggagaggtctcttggccaaggtcaaacataagctggtggcaaaatcaggagagagtcttgtatcctggttaagaggtataaggatccagagtcagacaaaactccatgtcctggatggccttatattagttatcttgctatgacttctggcaagtcaaataacttttctgagcctcagtttcaaaaattttaaaatgaagattatcatattgctcactgttatttataatgtggaataagtgatagattccacatcaactgcgtgacatctaacacctagtaagctctcagtaagttgttactgttattgctgcatctctcataatcatcactctgatcacctgtctatgtttgtgtcatcacacagctctagcaatgtttccaaaccaaagaaagggtcccttaaacttcctcagcaagggcttggcatctgttgtcatttgttgactgtttctcagatggttcaggaatgtatacggtgcgtattattaagtttgcagctccccttgatttccattcgtcacatttggtccataaattcaatcaatatgtattgaacaccttccttctgtacacaaagctctactagatccctaggatacagggtgaacaagaaggtataatccctcttgcctggggcttatgtttggagttgggagaatagaagctaaataactaatcatactgttgtttacttatggttgtgttcagtggttaaagttgagtaccaagtgctatgagtgagtaaaagaggggagtcaaagatggaggcttctcggacaagtaggtcttagctaggcatgacctaaggtataattatttttattttgaagggatggtatctgaggaggtacaggaagcagaagtcattgaaattttagggatgaatagaaagtcattgtggctgaagcaaggggatgctggaggataagggtggaaaggaaggaggggctgaaacattaatttttaggccatgttaagttttctgggctgcattataagaaaataaatggaatgttattgaaaggttatacacagaaaaatatcatcaccagatcttttataaagataattttagtgcttcatgaagaacaagtagaggaagcagagagaactgcttggggtcggggtggcttgtaatagagtgggggcagtggaggtggagagagatctgagaaatacaaagaggtacaaggaaccagcctggtgtgtgactggtgtgtcagtggaggcagagagagatgtcaagaatgactccacttttgacatgaactccagtcatcatgaatgttggagtaagactggtccatgatcatatttttttcctggtgaaataaagcacggaggagttctgagttctggaaaaagaccgattgaaatgagaggtgaaaagagaacgctaagtacgatgaggacagaagacatactttaaatatgttaagtagtaagaacatcaaatactaggagccagtatagttaagttacgaattgtgaggtttgtgtatgttagagttgaggaattcctgtttcttgctgttttgatgggcacagtgttcttccacgacagtaatcagataaactacttaggtcaactcaattaatctcttttaaaagaagcctggaataatctgctccgttctttgacataaattgattgattagaatgtttgcatccccaaattaaggtaaaaccactgccattttacagaaggtattgatcttatgtctgttaaaattgtatctttaaattttttaatttagttttattctttttcaatgagaatacagatttcaaactaaatgtagtgtaggtgtgaatgataataaaataccacataatttagtgtagttttcctatacgcattatattcatttcagcgcattatgatttcaactgtgtttgtacttgaattactcatttttgtttatcaacatgaggtttccatctgatccagaatcaaatagtttttattcagagttctattcatttactaaaaataatttcttatgaatgttctcatatatgcacatgcatgcatgttttaaaaagataacagaatcctgttattgccaagaaatttgggggtaagaccatggtggcaatttaagcaggttttgttttgttttagttttgtttttgagatctttatttctcccagctacctatcaaataatataggagggaaaactgtgtcccacaactggaaaacccataaggctccccagtcatctacctcaaatcttgaggagtctccagagctatcattgtgcaaagagatgtgggggagctgttctgacctgtttattgactcaatagtatgtgtcattcaaatttagggaatggagaaagatgctgttgccattctgctggccatgttacttgtcaaagcccataaccacgaatgtttggagaaaatttaaagttgaatataggagagaacaataatgatatggaagtttcctgtactactcaggaggatatcacatttatcaaataaaagaaacaataagaaaacagggctgggtgtggtggctcaggcctgtagtcccagcactttgggaggcagaggcgggtgggtggcttgagtccaggagtttgtgaccagcctgggcaacatagggagaccccatctctacaaaatatataaaaattagctgggtgtggtagtgcacacgtgtagtcacagctactctggaggctgaggtggaaggctagcttgaagccaggaggctgaagttgcagtgagcgaaggtcatgccactgcaccccagcctgagcagcaaaacaagaccctgtctcaaattatactacaaggctatagttaccaaatcagcatggtactggtataaaaatagccaagtaaaccagtggaacagaatagggaacccagaaataaagccaaatactcatagccaactgatcttcaacaaagcatacaaaagcataaagtgaggaaaagacaccttattcaataaatggtgcagggaaaactggcaagccacatgtagaagaatgaagctgtgtcctcatctctcaccttatacaaaaatcaactcaagattcatcaaagacttaaatctaagacatgaaaccatagaaattctagaagatacatcagaaaaactcttgtagatattggcttagggaaagaattcatgactaaggacccaaaagcaaatgtaagaaaaaccaaaataaataaatgagacctaattaaactaaaaagcttctgcacagcaaaagaaatagtcagcaagtaaatagacaacccgcagaatgggagaaaatatttgcaaactatgcatctgacaaaggactaaaatatcgagaatctgcaaggaactcaagaaaaaaaaaactaataatcccatcaaaaagtgggcaaaggacatgaatagacaattcacaaatggagatacacaaacagccaataaacatatgaaaaaatgcttcacatcactagttatcagggaaatgcaaaataaaaccataacgagatataatctcacacaagtcaaaatgactgttattaaaaagtcaaaaaataatagatattggcctgaaagtggtgaaaaggtaacacttttacactgctggtgagaatgtaaactagtacaaccactgtggaaaacagtatggagattccttaaggaactaaaagagagagctaagctgtgaggctgcaaaggtataacaatgataaaatggactttggggattcaggggaaagggtaggaggtggatgggggataaaagactacatgttgggtacaatgtacactgcttgggtgatgagtgcaccaaaatcccagaaatcaccactaaagaactatctgtgtaacaagaaaccacctgtacccccacaactattgaaataaaaaagaaaaaaaggaaagcaaaattaaaacaaagaagaaagagagattgcttgaggaaaaaaaaaacaacaacaaagtataccctttagtagagatagtaaatatcagaatggatgctactgaccaaattaattaactggaaggctgagaaaattcgcataactgtaagtaaaaaagaggttttataagagagaggatgacgcacataggataggtcttggggctcatctcataactaataataggaattttagaaatagagaacagatgagaggaaggaggagaactaacagattaccatttcctctaagccaaacctaattcttcaagccttcacattgaatgacctcactacaagctggtgaagattaatgaaaataaaaacttttagacataccatgatggaattttgaattccaaggtaaagagaaaatgtatacaaaagttgacacagaaaaacaattagttaccttcaaggaaaagagaatttgactattatccagtttctcatctgccacagaaaatgctagtggacaatgcaacattcctttcagaactgtgagtaaaaagggttgcaatcatagtattctctcaccagacacagtttgctcatgtttgacggaaaaatgtgcgttttgatacatgaaaggactcaaagtattctgcaaatgtactgtttaaaaaaaacaaaacaaaacaaaaggaggtagtaggaggagacttaaggatgtactatagccaaaatgaaaatgagtcaaaatatatcacaaataggtcacaatatgagaaggggtgcaagatatatgggtcacaaatgctgctacaagactggccctgggcagattgcattaatatcacctaaggtggccaggcctggtggctcccgcctgtaatcgcagcactttgggaggctgaagcaggtggatcatctgaggtcaggaggtcgagaccagcctggccaacatggtgaaaccccatctctactaaaaatacaaaaattagctgggtgtgatggcgggctcctgtaatcccagctactccagaggctgaggcaggagaattgcttgaacccaggaggcagaggttgcagtgagctgagatcgcgccattgcactccagcctgggtgacaagagcaagactgcatcttaaaaaaaaaaaaagacaaaacaaaaaccacctaatgagattttctttccccagctttattgaagaataattgaaaaataaaaattgtttacattcaaggtatacaacttgattattttgacatgtgtgtacattgtgacaagattaccacaatcaagttagttaacatcttcatcacctcacatagttacctttttttgttgtggtgagaatacttaagacgtactctctttgtaaatttcaagtatacaatacattattactaactatattcaccatgctgtacattaggtatccagaaatcattcattcattaggtatccagaaattattcaaagtttgtgccctttgaccaaaacctccctgttacccccacacctgccccctggtaaccaccattctattttctgtttctatgggttcaactcttttggattccacatataagtgagatcacgcagtatttttctttctgtgcctggcttacttcactttgcataataatgtcctctaggctcattgatgttgcaactggcagaattttttttaagactgaaaaatgttcagctgtgtggaatattatattactattaatattatatgctatattttatatataccacaattgtgatgggtgtaccacaatttcttcaatatcagggctattttgaataatgctgtaatgaacgtggaagttcatctgtctcttcgagagagctattttatttcttttggatatatacccagaagtggaattgctgggtcatatgactgttctatttttaactttttgaggaatctttactgttttgcataatggtatattcattataatgcataatgtcaatttatatccccatcaacagtgtttaagggcttcgttttcaccacatccttgctcaacattagtattcatcagggaaacgcaaatcaaaaccacaatgaaatctcatctcacacctgttaggattttttttggttattatctattatttttgataataattattatcaaaaagtgaaaagataacaagcaagggaattctgccaaggagactttaaatgctgattcctggagtccaaagtgagagattatgagagtgtaaacctgagataggtcccagtagtctgtatttttaataagttctccaagtcacctgacagccaaatttggtaacctgagagtaatgagttcagtaaaatatattacaattaaattattattgataatgtaagttatgaaatattaatgaaatggttaagaaaggatcctcaactgcaaggacaaaaatgcaatcatttttgtctgaaagtaaattctagcttatttcaagagaatctaggtgctgtgtgtatgttgtgaatgctgtgtagtgtaagggaatcactgaagacttagaagcttgtaaatgcctagccttgttcctgaagggggagctcttagagaccgtttagtcattgagattgatggagaaacattacttacatatgcttatatatttaaagattaccaacagtgaaatacaaataagatgaatagctccttaatggctagagaatgcaaaataacacataagaaaaagaaagcttcgatagtagagtaaaaatttggaagaaagaaacgagaaaatataaacaaacaactatgagtgatagaatgtagtttgatagtagtaatcatttcactatgtatatgtatatcaaaatattatgttgtgtacatcagacatagatgtaataaaaataaatttaaaaatatatatgcaagttacaattaaagtaggtaaattaaatcttaaattacaaaacatttttgcattagcttaagaaggataaaccaattccatgctgtttaaaagaagactttttttttaaatggcacaaagtaattggaaagtttttcactattatatctgcagctcttggcatgattggacatatggttcaaaaatgattgccacctcatggaatgaatggatgtggaaaagtataacagcctcctatcacaaccacaaccaaaaataaaaaggtaacgtgtaacaataccattattacaatacacttcaaataataaataattagatggcacatagggctatttttaccaaaaaatccaccattaaacaaggtataatagcatcaaacttttgtgcactgaaggacacacattatgatgaattggaaacataaacattcaagaagaaattaacaaaactattaccagactgggaaattttaatacatctctcagaattggactagtcaaaaaaatccaagacaaatgatgtaatattttccacaatattaagctcataccaatgctttgataaccataagctttttaccttgtcatttaataacattttaattgtaaaataaagtaaatatgatgactaaaagtaaatgaaaacattcgaacaaaatacttctttgttttcaccctggcccattttaatatgtccacttggcttctaatagtatatgatgtttccctttcctcgtttgagaacccctggtttgaatattacagttcagttaagatttatttcaagaccaggcatggtggcttatgcctgtaatccctgaagcagaaggatcacttgaggctaggcgttcaacagaccaagcaacataggaagactccatctctacaaaaaattttaaaacattagctgggcatggtgttgtgtgcctatggttctagctaggctgagccaggaggatcgcttgagtccaggagttaaaggttatagtaagctatgatgaggccattgcaccccactctgacctgggtgacagagtaagaccttgcctccatggttggaaagttatactctacaaatgtagactgtatattgtttcaaaaatgtttttggaatgtttatgaaatttgatcatatatgtaaagaaaatttcaaatattaaatattaaaaatcttataggttatattgtctaattaaagagcaataaaattataaattagcaaggaccaaaaatatgagctacttggaaattaaaattaaacttgtgaatggcttttgggtttaagtggaaatcaattatactatgaactatctttaaaacaagtcacagaaaataattattcaggattctaatatgtggtcagatgtttactgagagagatttttaaaaatgtaaatgcatcattcttaaatatgaaagattgaaattaagtaatctaaacatttaactcgagaggctagaaaatgacattataaaacaaaataaattaataaaaagtgaatagttatttaaaagtagaaattaatgacttgtttacatataaaatatatagaattaaaaataccccatatttgaaaagacttgtaaaatcaacaaagctttgttgtttctgattcaaaaaaatgagttcataaatgtatgatattaaatttaaaggagataggaccatttgtatgtaatacattttcaaaatcagtagtgcttgttatggatgtaatacttgcaagcagatttggtgatttgcttggaaaaagaaagaaccactttgttttttcgaaaagaaaaatttcctgcttaaatgaattgccaagataaagcaaattaaagattgtcttagatttaccctcagttctgcaaaatacacagattcagatggcttcctagttaagtgctgaagctcaagagacaaatcattaccaagtgatttaaaatgtttcagaattttaaaactaaaagtaatagggaacactttctatcttatttaaagttcatgttttgagagtctaatatatattgtgaaattttagaaaggctgtacgaagtaacattaaaaattgtagaccagcttccttattattactcttgtaaatatgattgaatcgcaggcatcatcaagttaaaagaatgatatacacttaccaagtatatttgttctaaaaatgcaagaagagttcagtattcagaggtatattaatataattatttataatacattgaaaagataaattccacatctctattttgaaagatgtttaacgccttttgatgaaatcaaatcgacattccccagtaacatttttagaacattaggaatgataaaataaactttttttttttgagacggagtctggctctgtcactcaggctggagtgcggtggcgcgatctcggctcactgcaagctccgcctcccgggttcccgccattctcctgcctcagcctcccgagtagctgggactacaggcgccgccaccacgcccggctgatttttttgtagagacggggtttcaccctgctagccaggatggtctcgatctcctgacctcgtgatccacccgcctccgcctcccaaagtgctgggattacaggcgtgagccaccgcgcccggcctagaaactttaaagctattatgaaagatatgaaaaacagtagtgaatataacaattcactgtaaacagtaaaactgtttctgttttaagttaaagaacaaatactctttatcaatgctcttagtcaacaatgctctgaagattatagttggtaaaatgaaaacagaattaagaataaataatgggaaaggacaaatattactattttcagattgtatatgggttcttcaataaatttttacaattaaaagcttttagaactaatgagttcactacatgatgagagataagataaatgaaactagttattagctaatacttgcaagaatcaaaaaagtaagggaggccgggcgcggtggctcacgcctgtaatcccagcactttgggaggccgaggcgggaggatcacaaggtcaggagatcgagaccatcctggctaacacggtgaaaccccgtctctactaaaaatacaaaaaattagccgggcgtggtggcggcgcctgtagtcccagctactcgggaggctgaggcgggagaatggcgggaacccgggaggcggagcttgcagtgagccgagatcgcgccaccgcactccagcctgggcgacacaccaagactccgtctcaaaacaaaaaaacaacaacaacaaaaagaggaataatattatattcacagaagaaagaaatacaaaaaaattagaagtaaacttaggaaacttaggaaatcatcaagacctacatgaaaaaatagtaccattcactatatgatataaacaagtgcttgattgaaaagtaaacacactctcctcctaaatgggaagtcctgtcattctaaggatgtcacatgtgcccacattaatctgtaagtttactgaagttcaagtaaaaatctttacagtttttctgtttttgttttttgcttagaataaaggcagaacttaatgaacctaaatttgatttggagaaaaaagtgggtagagaaatgtagggagtgaacagagccttttggaagagggaatgggagactttactagatataaatatgaatgtaaaagccaaaatattttaaaatgtactgtcagtaaaaacttatgcagatgtagatggatcaatagaaatagaacaaaccgtagttataaatttaagtggatattaaatgtcatataaaatgaattgtaatatggattgataactcagcaaatactgaaaaaatggtctattttaatacttagatcaataccacttcaaacaaaagcacattactctgaaacttaaatatagaaataatcacatactactatacgaaaatacagaatgtttctaacttttaagcaaggacttcctcagcctgattttagtcgaataactataatagaggaagatgtttctttaaaaaactaaattctgtaaaacacgaattctttataaacacaaagtcatatataaacaaatgtttattgcagtattttttattacatccaaaaaccatgcacctaaatgtccaccaggaaatggacagataaataaaaatgatttgctcttaccaaaaatgttaaaataactttaaataatgataaggtgggtctacatgtatggacctggaaaaatgccattacattttcagaggacaaaaacactcataaaataggatgtaatatgtgatctcatttttataattccacgtctttgcatttttgtctgtcttttgtgtgtagaaaaagaaaataatgtgaaactaataccaacttcaagaattaaggggatgaaattacacagtggagatttttaactttatttttatatattctgaaatatttgaatggtgaacagtcattgctttaataattggaaaaagtagagctatttccaatttgggttaaaaaagtcagtgggacattatcgtctatattctacctgtatgattgagatcctaagccaaaccaattcttagagatattctgaatgacatatcccaaagcgcaggtaagtacactcactgttagactctgctcatagttatgagggaaacatagtctccagtcacatcaaaaaccatgaaagacaagaaaagatcattagtatactgtatttacttgagttacttactgaatagtatgtactgggctcttggtgtgtttggtattaatattgactgttgggttctagtctagactcttggttctgtggtgctgtcatctataccattggtccttggaacaggagcacctaggaacttgttagaaacagaaagtctcagacttcattcctgacctcgtgaatcagaaatttctggagcccacgctcaatcagcaagcactccaggtgattctgatggatccgaatgtttgagaaccactgctctgctgcatccaggggaaagctatttactaagtcaagttttattgtaagttgatctttctcttttgagtatatcagaatttattaagaatgattagaaaattgattgcaaaccaaagagtggataaagaaaatggggcatatatacaccatggaatactactcagccataaaaaaaaacgaaataatgtctttttcagcaacttagatggagctggaggccattattctaaatgaagtaactcagaaatggaaaaccaaacattgtatgttctcacttataagtgggagccaagctatgaggatgcaaaggcataagaatgatttaatggactttggggacttgaggggaagggtgaaatgggggtgaggcataaaagactacatattgggtacagtgttcattgcttgggtgatggctgcaacaaaatcccggaaatcaccactgaaggacttatccacgtaaccaaaaaccacctgtaccctaaaaacgattgaaataaaaaacaaaaaaaagaaaactggtggcaagtaggccagcccatgaaagccgtttaatacttggttaagtagactgacattcttttcgtagatggtagggagctttaaagatttctgaatgtgagaaggacatgagtggttgatgtccatcaggacaactgctctagctgcagtgtatagcagattgcaggagactgacagtggagatggagagccaagttagaaggcaattaaataggtcaagcaagaggtagtaaaaacctggattggagtagaggaaatggaattggaaaagagacaaatgagaaagagagattgtgaaagtgagaacagtgcttggtccctgatggcatgtaggggccaaaagagaagaaaggcaaagatgattgacgttttaagcctatgtgacaggtattattggcactacagatcagaacaactatcagtgatctgcaacgtggtagattgtgctgatatcagtcatcacacagaagattggtttgtttggatttctaaattggggcttttcagttcattggaaggatggttaaaaatctcaatgattagcattagaacaaaagagaacagaaatacagttgagtactttgccagactcatcaaatatgattttgatgggctaagaactcctaacgaggacacagtgatcaactgagcaaacagaccatttggcttgaacagaaatgtcaacataggcataatctactaagttgctaattagggatggtactagccggttgatggacttcagccaagacatacagaatggtgagaagccagtgcacagagcctctgggaatctgaatgatcaattatttttcatcccataatgtaatttacctgtattagaatttatatgcagaattaaacactccttcttcagagtttccacagtattctagatttttattgaagtatttattttaatggtttatttatcttgggcagagctttttgtggggatatcaaactgttaatggatagaaagggatagattgaatattcctgagagttggatcagtgtgaagtaaagttgaagttggttatactatggcaagtatgatgtagagaaaatctttcggatgttcgaaggtcaactcagctacttacttccttttataatttggttcgacttgaacactatgattcctcatttgttaaatagaaataataataatagtttacctcatagggttattataagaattaaatctaaaatccagttgacttgaactctaaaagataaaataaaatttgaaaaagaactaaaggaaaaaataattaaataaaattatgcatatgcaatgttaaaaaacagaatcggaaaaataatttctcaaagagggtagctgttgttgctattatcgttgttttattttattgtcaaacaggctgtgagagtcaactagaagggtgacgatcttgaggtaagaagtttttgcatccctctagcatattttacaagcagcatcaggtacaagctaaatgagtgtcgctgagcctgaacttgtttggtgagtagttgaataagggaatgataaggcccacattcatttatttttacttttaaggtagaagggtgcagcaacttggtttctgcagaatgtatcacttgctgtcttttccgtggaaaagaggctatagttgttcattcagattgaacaactgattgtaaaattgtaatacccctagatggaggtgtataagaaaactaagccatttcttttcttataaatatgcatacatgtcttagttcattcatgcttctctaacagcataacatagactgggtggcttataagcaacagacatttatttctcaaaattctggagactgggatttccaaatcaaggagctggcaaattggatgtctggtgagggcccacttctggttcatagccagccttcttctctctgagttctcacagggtgtaaaggaccaaggaactctcctgagtctctttgatgagggcactaatctcattcaaaagggttccaccctcatgatctaatcatctaccaaaggccttacctcctaatagtatctctgataggccagtcttgtgttgccagaaatgaacattctcaagttcatttcatgccagaaaggaatatctgagactgggtaatttattttaaaaagaggtttaattgactcacagttctgcaagtggtataagcatggcattggcatctgctcagcttctggagaggcctcagggagctttcagtcatggcagaaggcaaagcaggagcgggcacatcacatggcaaaagcaggagcaagagagtggggaagtgccacatattttcaaacaactgtatatggacactcattattgtaaggacagcacgaagccatgagggatcctcccccatgatccagtcacttcccaccaggccccatctccaaaactggagtttacaattcaacatgagatttgggtggggtcaaatgttccaactatatcactatcacattggtgattaggatttcagcatttgaatttgcaggggacataaatatttgatctatggaaatatgtataagacatttatttaatctataaaataagatctctaatgaatgtgttataaaaggtagcttctaggttcactgtcctattttaggaaacttgcaaatgttcattagtctcctaaacctctgccgatagcttgccttttctttgtgaccttggattttttttttgtaggattccctgtctagaatatcctagcttgtttttcctaaacatggaaatcactaatccttcatggccgagtttaccatccttctccttagtaatttcgctttatttcaacaaggaaaaaaagtctgagaaattctgtagcactttggtccattgttatgacatgcatttcaaatgacctaacactgtttatatttgtgtagaaattttatttatcttattagattgtaaactccatacaagaaagctgaaaaaataaaattaagaatacggggaaaggtttgaagcagaaggtcagagacagaggcttcttcaatgccatacagaggattgggcttgagtagtaactactgcttgataccagatgacttaatctctctaaccatgatgtaatgaaccagaggtgggtccctgtccccaaaggactgtgatccttaataagtgacttggtaagagctctggctaactggtgtgttgaaaatgtcacaacaccctaacctgatctgatcatacagacagaatgagcagagtgattggactaaagctaaaaggcagagagagggcaatgatattacaggcaagcagctagcacagcaaaaaattcaatgtaaataaaatagtagagttaggagaagattatctgccctctttaccaaccccttcatctttaagttaaatctcatgaactcaagttacctgaaaatatggtttattccatgtatgtgaaaaaaggcctgactagtacagcatcattttgtaatctctttggcagaaatgattctttttatatgttgagtctaaatgcactgccttgtagcttccatgcacaggtacttgtcatgcttcctgaaatcacacagaacatgcattaactatgtagccaatgacaggccttctaggatgagcagattcttcaacagtagggagatgtctttcacaggaaacgaatgagtatttgtcagggcttcacttgatatactttctaccactgtcccggtaaggaatagcagaatataaataaagggtctaatatgtacttattaatgagtttgctaaatagaatatatataccacttagtgagtggtactatgattgttttgggtacatacctaagattagcttttgttttaatagtagaaatatgtatatattattatgtatattaggaaaatataaccagcatggaaaacccatggcttccttgagtctattcattaagacaaatggaaaatacatatttaaatttaaaataagaatttaacaatgctaagtaaacagttctagtggtatgcacatatggccaacataatggaggatgtttgctaatgatggtaattagtataacactgctttaagaaaaagtgtcaacagattagcatgatatgccacaagcaaactggaccaagattatcacttttatttttgctttctaatttcagcggttaaattttaagatatttgatatagcttaggagattgattgctttgaaaaccaacttaaatatgaaataaagaaactatactagcacaagtaatgcaagaaataaacatcacttcaaggtcaatatcaagaaattggaaccctttctgaatttataagaatattttgagaaacaactttcctgtcaaatggaagtcaggagaaaatcaacaaagagtcacctttgtacccaagaaaacctatagacacatgtaacagcatgcagaaatataaaggtaaaaaaatcactcaagagtcagtgagaattttttttagtaaaggtcatttgatgtccacttccttgtatatcaaatagttaaatgcggatgaaagcaggagatatgaataatactagaccgtgtatccattaaggaatcatgaaaacaaaagtttaaagcaagaattgctaaaaccaagtgttttctcaaaagagctcttaagtcaaatgtagaggtaagaatatatgactttatcactgtatcattttattacaggatggaattcaacattttcaatgtgattttcatgtattttattgatttgggaaggttagcgattaaatattgttaataacattctacctggtttctcaacatctcatatcttttttcctctgacccatcagaaatactactggcacacttgtctccccagtgcacttcttggattgtttttgctcctctgctcaccacacttcttgaggctgcttcctgaattcctccatacatatgaattctttagcaggctattcagcatgcctgtgctgtctgtgccaaatctaacttccagtcattttcctttgcacttgtgtttggctacttaggtttatcttaatatgctctatatgccagggctcttcagagaagcagaaccaatgggattgtgtgtgtgtttgtgtgtgtgtgtgtgtgtgtgtgtgtgtgtgtgtgtatctccaggaaacttcagtttttacatttaaggctttcagctgattggatgaagatcacccacattaaggagaataatctcctttacttaagctgaattgattatagatgttaatcctatcaacaaaatactttcaaagcaatatcaagactagtgtttgaccaaacaactgggccccagagcctagccaaggtgacgcataaaatttaaccatcacaattgccttgcttttctttctctatcgtctggattttaaaattttttatactttaccttatatgtccttattccatattcctaaatttgaatacccttcaagccccagctcatttctctcttattttcaaagtcattaccattcacttcatcctggaatggtagctaggacctgtgaaattctgtagcaggatgcactgctttcatagcatgcatttcatgctgcctggtgttgaaggtatttgtgtaaggcttttatactctgtgagagctttgagcttctcaagggccagagctgtaacacatatgtctttgaattaatatataattcattgctctacacaaaggtacatacttttttttttgttttctgaagtgcagagtgctattctaagccatcttaaactcaaagaattatagaaacgttctggcatacagtcagaatatggaataggaagagtgtttcacaaagtgtgataggcatcctaccacacaaagtagtgtttgctttaatagattcatgttcatgttactgtgatttagaaaaaaaaaattgtaacatcaaaccaatgaattctcagatattaatgtttaggatggtgttaaaacagagacttatgttaggcttgaatcaatgattaaatatttatttgagggtcaatgttcaagtatgacaatgtagtaaaatagtatgtgaagaaactaggtttgttccatgttaacttaatgcagttctagactggaaatgaggagaattgaaattctataggcccatcactcattgtgtgtgtgatcttaagacatttttacctcttggcatctgtatcttttttggggggtaggtattctgttatcatctaactctaaaagtgtaatttgctactaagatgcctataaatacagccagactacaacacagatggtgcacacaggaagaaaatctctgattggtagactaacccaaaataggctgtgtatatattgaatgaaatacgaccaaaaaatctgcaaatagcagacacagagcatcctttaggttggaactgagtaaagtagatttatgatctaatcttacttattctatgacatttctgtttaatgaatgtccctgatcctcctgccatcttactcacatttctaatgtgctcatactccgaggtaataatgatcatttgcaattataaatgtcctgttatcaattaatttgcagttcaccagtaaccatctgattatctctaacaaagctgcgctggtgtggtaattatgttgagagtaatcatcatgtaattgcacataattatttgtaccttattaagtgctcatatgattaaaatatttctggtcaaataaaaattatccgtgagagtattttttggaggggggaaataagaaatgttgcttcctggtcttctgttctttgaataaggtaaagctgtctagctgacagtccataatgccccagataggatgaattagtaaggagagaagagacttagatttcattaatacaataccttgtacctccaatgaagttgagataataaacttcaacttccagcatggatgaacgctttccctgtagtagctataacaaaaaatattaccctattaagagtgtacactatgaatgtcattgaggacaatgtgtttttcatgtccaacaccgccattagcaattttatactgaacttttatttttctcatagtactctctcttcaaaacttttaatattcacttatttacactcagtgttttttttaatttccagggactgtgtttagtgagatgatctacaggtataattccaaaagcacctaccaaatttgtttattcagacattcattaaagagcaactctatatactagcactctcctttagaaatattatgtgagctacgtagccaaatttactttttccaggacccacaaacaacagcaagaaataggtaaaattaatattagtaatatattttatgtaaaataatcattacttcataggtactcagttgtaaaaaagattagtgaaatattttacattttttgtactaagccttataaatctagtgtagattttacttatagcacatctcaattcagatgagcaacatttcaagggctccatagccataggtagcttatggctgctgaattagatggtgcatatatgttgattgtatctacatggtagataaaggagagtcctaattaatagttagctctctgattttatagatgtttttatgagtttcaatttcctaatctggtaaataatacatctagcctaaaacatttctttttaaattaaaatgttttctagaaggatagggatggaactaacattaagggactgctttactaggtcatgtaggatactaggtatatttacatttattatcaaattcattcttcacaatagtctagaagggtatgttactttacaggttagaaaagtgagatgtaaagtttaaccttatcaatagtagaatagtagaactgggattcaaacttggctatcatctttgaccacagattttgtctcatgcttttcaaataagaaacacatattttgggtccacttgctcattgataggtctagtaagaggattttacttccctgaatactgtgtaaaaggcttgactgcaagaaagttactgattagtttgatttttagggtttctcctgaccttccttatccatgtttcccagtccagtttcttgaattagtctctcctgaaagcttgttctttccagcaaacttatctcaagtatagcataaatcatcttccactggcattttaactgaaagtctgttgactatcacgcacacttacagaaagcctacctttggggataactgagtgactgacagcgatgccttagcaaccatctgattgtagttacagaggaaatttaccttggattgaagaatcacatgccattgtgattgacagagtctgtaagacaatcaaggtcaaacccagagtaaattgagtatgtggctatgagcattgacagataagtcatgtgtcaaatattgcctagccatctggttgctactcatgattagactggattcattgtgtttaatttcttattgaggacaactacatgggaaacttgtttgtttttagtttatcagtgaaatgtgctttatctgctgacataaaatgtttctgcctaaagtgaacttgcaaaatcattagttttatgactccagcatgacctacaaaaaattattatttaaaagtgattgatgcattattgaaaaaaatatattaggtgctgaaagttacactcatgaataaaagcacaattccttaaagaggaataagaaaacaaatgtgatcaccccgagggtttttagaagcccccaaatgtttaaagactattagccaaactgggtaccagatatgtgggtagtgagaggtgatgagatgtcagtgataagtgatgtataaggggacaggtgccttgtgtgaaattctgaaaattcacatttagtagaacgtatcaaacgccagtagaacgtatcaaacgccagcaaatacttagtttatttttgaggacaaaagtggaaaacacagggaagtgaaatcaattgtcctatgtcacattgtacttggaatggggctctgagtcccctgactactaatccagtgcaatttcctcctgtaactttgctgcctttgtaaatgattacattttaaatacaagggctgtttggcttattaattagttagtgttaaaaaaagccaaagttgcttttcatcactgatggattagtacctttcattctgttttcaactaccatattgtccttttaactgaactattaaaaacatttttccttgttgatcacagcttgggtgaacaaagtaggggctaatgaaaataaattcccggtcagagaaaatggcagttgcacgagttttggtggtatgatagtcacatttgcatatgtaaagtataacactacataagcaaataatatgacccaattttaggtggtgatctatatgtcattgctggttcctctgcaagaataaatactgaatgcttctaggcatttccagtaagcacagtaaatccatttcaataatgaagaattcctgagaaaacaatataatagaatcaacaggttctagcaaagtggaattttatcataaattacaagttccaccatgttaacacgtacattgcaacatgttttggacagtacttctgaggttggaattctcagcaagtggttcctattttgacatccagacagtgatagccatttgtaggtggaaaattagttatcagctgtgccttgctttttctttacttgggtttctctatttctctgtctttttacacacacacacatacacacaccccacacacatatacacatatatatctatccttggatatccaaaaaaagattctcaataaattcacaacactaattgaattgagatgatataaagttgttgattatttttaataaagtctagagatctaacattagttgtagcttatttcttcactactaaataagaaattccaagttaagtcttttcatcttttcattaataaatagccaatatgtaatatctgcccatccatatatattatgaactatctgaactactccttataattatggggtaaccagtcaaataaaagtgttgaataaacagcttattgtatatgttatgaattacctgacttaaaattaggagtcaattagtcaaaatgccatgggctatatgactcattgtaacattaataaagtaaaatatgtcttcctataatccagttattggtattaaataatattgaagctattttccaagcaaaacttccgcataagtttgtttttgtcttggttgagaactggttcttttgagataaagccaccaactcagcacaggtttttttttttttctcctgaatggttttgttcaacttaaaatgactgttcctaacagcaggtgctctcttctttgtttcagattatattgaacatgcttttggtcttcacaaatactgaaaatcaactataaaaatgctggatgaaaagaactatatccatatggtaggaagataaaattttagctctaactcatatcttctctgaagaagattcttcagtaagttcaataactaacattatacattcagtcttttaggaaatccttggatctattttcaaaatatatccagaaacagaaagcagctataacatttgactggatctctcattatgagtaaaataaaatctttaacagctattaatcttatacatgatatgacagccgtgattttacctttcttttttaaaattaattttaacagctttggagatccttcactgagatatccagtgggttcaactgacaaagcaaggcacaatttatcatgtaggaatgtacttcacgggaaattttcttctacatatgttttctcttggttcccagagatgaatccgtaataacaataggattctgctaactttgtttttctgattccagttttcctctttactaattccatggctctttttttggggctcattttttgcccaataaattattcccgcttattgacaggactgatttgggaatttaaggtctgaccatttggtgatatctataagtagattcattgtttatagagacctgttctctgttaggcgagagacaatagagaatctagttgttagtctttatctgtttgtttgcttgccaacactgacctcaaataaattaagaattttgtggccactgggcaagagaacagctctttgatatctggactgtatataactggaataatggttatgcacccaaagccatacatggaatgtcatatttgagaatgatagtcacataaccaccccaagctactaagatgccataagtctttaccccaaatgtgtcagaaatggaagacacttctctcctattagaagaaacaaatacgtttggaaaaaaatatttttggataggataacagagaatatcctctccagagaacagggtagtgaaatatattttgttcacataaactgaattttttttttctttttttgagacgtggtctcgctctgtcacccaggctagagtgcagcggcgtgatcatggcttactgcagcctcagtctcctgggctcaagagatcctcctgcctcagcttcctgagtagctgggaccactatcacacaccatcacacgtggctaatttttatgttatttttattattattttggtagaaacgaggtttcaccatattgcccaggctggtttcaaatgcctaggctcaagtaatccaccagctttggcctcccaagggttggaattttacaggagtgagccaccacaccagcctgaaattttcattaaaaggaacttcccttccaggaagggatgaaggaggacttttagaacactagaaatgacagcccaaagagacagagcccagagcatgggtgagggtgagctgtggtgtcttgaaacctagacacttgttggtggaaccagcttgggaacacaggctaattgggaagtatggaaggaggatgcttcagacacaattgaatttttcagtgttactaggacatctattcctgtgtatgaaccacccgcctgctgtggtttgaatgtttgtgtcccctccaaaactcatgttgacatttattctcaggtgaaacaatattatgagggagggcccttaggaggtgataaagtgccttataaaagggcttgatggggcgagttacccctccatcccttcatgtaaggacacaacctcatcccctctggaggatgcagcaacagggcaccatcttggacacagagagctgccttcactagacactgaacctgctggcaccttggtcttggacttcccagcctccagaagtgtgagaaaaaaatttccatgtttacaaattactcagtctgtgttatttggttataacagcacaaatggacaaagatactggcccttctgcaaaaattcaggtcctcaaaatctttgtgaaggatgtggcttttgttactttgctttgcttaagaagggagagtggtctacaatcacagggttgtttacctgcaagctcctcctgggcctggattcctcattgtgcaactgttgtgttatcttcagtgtccacaccactcaaagacaactttggtttgaatggagcctggcctgggctttttacagaggctgacattgatttggcattctgcagggcaccttgctgacttttgttttctctcttgggatgtatccactgagacaaatgactcatccattctctgaatttagttttctgaggagtctgtcttctttggggcagaaatggggacacattgctcaccacggtctctctcttcctctgacctttgcaggaaagtgctttccctctagtgtgtaaagtccccaaccctatgtccaaattctggattctttactaattggaaactgctattataggattcccatttttttcacttggctctaaattagtatcccagatctttcaggagggtctgaaacttaggggattcgagctcttgctaccccagggcactttccatatgctctaagtggatctataaaacatgggaaggtgccatatccccacagtgtatgctatggggatgaggctgtgagccattagcaaattttctgggtcagtgggcacttcagttgtacaatcatgagcccggctctcagtctgtgcctctgtttagagttttaactaagaagaaagatggtcttcggggtgtgatttccagagatcttggactgccaataatggtacaaagtatttcttggttattacagcccttagactactcaaattgtcattgaatatttgggagattctaagctaattagttctctgtgtgcttaatttattttctggttttgttttatgaggcatgtgggactccatagccttaattataacatatccttggaaccattggtcttttcttttttaactgtttttttctttttttaattttttattattatactttaagttctagggtacatgtgcacaacgtgcaggtttattacatatgtatacatgagccatgttgctgtgctgcacccattaactcgtcatttacgttaggtatgtcttctaatgctatccctcccccttccccccaccccacaacaggccccagtgtgtgacgttccccttcctgtgtccaagtgttctcattgttcaattcccacctatgagtgagaacatgcagtgtttggttttttgtccttgcgatggtttgctgagaatgatggtttccagcttcatccatctccctacaaaggacatgaactcatccttttttatggctgcatagtatttcatggtgtatatgtgccacattttcttaatccagtctatcattgatggacatttgggttggttccaagtctttgctattgtgaatagtgccgcaataaacatacgtgtgcatgtgtgtttatagcagcatgatttatattcctttgagtatatacccattaatgggatggctgggtcaaatggtatttctagttctagatccttgaggaattgccacactgtcttccacaatggttgaactagtttacagtcccaccagcagtgtaaaagtgttcctatttctccacatcctctccagcacctgttgtttcctgactttttaatgatggccattctaactggtgtgagatggtatctcattgtggttttgatttgcatttctctgatggtcagtgatgatgagcattttttcatgtgtctgttggctgcataaatgtcttcttctgagaagtgtctgttcatatcctttgcccactttttgatggggttgtttttttcttataagtttgtttaagttctttgtagattctggatattagcctttgtcagatgagtagattgcaaaatttttctcccattctgtaggttgcctgttcactctgatggtgatttcttttgctttgcagaagctctttagtttaattagatctcatttgtcaattttggcttttgttgcaattgcttttggtgttttagacatgaagtccttgcccatgcctatgtcctgaatggtattgcctaggttttcttctaaggttttttatggttttaggtctaacatttaagtctttaatccatcttgaataaatttttgtataaggtgtaaggaagggatccactttcagctttctacatatggctagcctgttttcccagcaccatttattaaatagggaatcctttccgcatttcttgttttagtcatgtttgtcaaagatcagatggttgtagatgtgtggtattatttctgagggctctgttcggttccattgatctatatctctgttttagtaccagtaccatgctgttttggttactatatccttgtagtattgtttgaagtcaggtagcatgatgcctccagctttgttcttttggcttaggattgtcttggcaatgcgggctcttttttgggaatcattggtccttgaaggcagctctaatttcacctcatagctctgctctctgaagcacgcctctgctatggctggagtcccttgggggcgtgattcccattcttattcctaggttcacgatcagctgttgtgtaacttatagttagctctgggttgcccttttggcccccattttagtcacattctgccgggttccgtcttagttgtagtgtgtgtgaggacacaatatcgactacatgcagagatgtatttaccgtctgccctaacctgatgagtctatgcagggcccttgcaaatatcaaagcaggaccaccttatgccgctagccttgcttactcacaggagaggactagatgccacatttttctcccatgattatctgttttctctcagctcagattttgagtctgcctctgaaacatgggtttctgagtagggaaaggtggcatggtaaaaaggccaggattgagatgttctcttttgacaccatagttttatggattcaaggaccatgagaagtgcatcctacttctgccacttgtgaaagcaaatcaagtgggttttaagatgacagcaagaatgaaaagggagaaaaaaaaagtgggtttgctatacttgtcaagtgcctggatcaaggaaggatcaaggaggctttctgagccccttgattggttaccttttgagcccttccccaatcattccctaggcagaattttctgcatcttctaagtagaattttcctgggtgcttcagtacaatccacttgagatccttgttcctctggcccttcaacatggaagtccatgagagtccatatttgcctttccattgagaggtccctaataatttatctttaggctgcatcagcaagagtccctaggattctgtaggcctggcccctctcttgttctgtgagtccatgttgaaggccgtgtccaagttgcttcctcatctccttgctgaaaacaaatgcttcaggaaagatagagactaggacttaggatgaaaaggtcaagttctcctgaggaagattgggagctggagggatggaggcttccaaagatctctgggcctcagtgggtaaataaagtccagaaaccttttagctatttctgctgcagtgccatttcaggcatagaatttcaggtagggtgagaaactgtacccatttctgggttctagggagggatactctataggcattaatctgagggagagagggttgaaatctggcctctcaggtacctgtgaaccagacagaaaggcagtaattagggcaaagttgcaggaagatgctggtgctgggccttggggtgggaaacaggttgcagctgaggaagcagtaggaattctttagcctgcattagtatttggatggcaatgggctttacattgaataaacaaagggagactctgttggggaacagctaccacagactaagactatcagctacaaagactccctgtgccctcccaggagagttaactttacttacactgcaaatcatgccccaagttcttgagagttgggagatgctatgtacactgcagctgctctggttgcccttcagtgctctagagggactgaggattttgccctgttcatcattaagtaattctgtggaattcagaaaattcagcccataacctgacctgagatgttttggaaatgacctttccttctttttttattttctgaaatctgaaaatccagtttctttatgactcatatcttcaaatgcttattgacatccaggctaaaaaagaaaaagttgccagcttccacatgcagggtgtgcccaggcaggggtctgtgatgtgtgaagagaaaaatgctcttgatgtaaaacacaatgtgaggaggtagggaggaacaagtccttcaccgatgcctgccgctagaaggctgacctggaagttggggtccatgcctgagtaccttcaaacagaagaggctaaccagctgaagaactcagcagatctctctgggatggtactcagtgcaataacaggcacaacagattgagttaacgtggtatatggtagtgctggaatagagagggtcagtgttgtaggatgtcagataaatgaatcagtttgatccatggaatgggctgaaggttgagagagattgataccctgagagaggagtcagccaaggccatattcttctcgcctccatgttgtccctgaaaaacaaaaaaagaatgaggggctggagccccattctgactttcctctctctaagcaagatggcgctcttcattattcatgaaaaatacgatttccatagaactctgtgtccattcctatgttattcattttttttaaagtgactaaaatattttctaatgctctttgtgaaactctaataacgaactttcagtgagtgattctcaggttactctctcgtcagtagccttcagccaaggacggatgccaaattttagacctgtgattaccggaggttatcatctgatctgatgactttagagactcatcattgctcctcaaatcagttgtgacacaaaggcttggaccagtgtctcctcatacaggaaggtgatgatgaacaagtgctgtgagactctgctctcctgcagataccctgtgctttcttaatagtccatttcaaggtcactgaatcagtgtttgggattctaccccagagtcctctgtgagtttatgtgtgagcgttggcaagaagctttctgcccaactctaacctttgccctgctcagtctgttccactagaatgataatgggcaaatatttcctgagacatttcttctcattgatttagtaaaattcaaagaataacagaaatgacaaaagtcaatctaagcagttgggtggatctagggttcccacatctgacttgtgtgtgtgtgtgtgtgtgtctttgtgttttttttttctgaaataatgataaaaaaagaatttttctagaggaagcacaaaaacagaaggaggtgtcctacactatacagggaaaataaaatagataaaatgcttcacaaagttgagctggagctcatccatgggcataaagggtctttaggagctggaaagatttctccttttttttttctttttttgcatcacattacttcctttagaactgggtaccaaacatgaatactctagtctacagttccaggccagcatctcagagctacgggacagtctgcatgggtggtaggtgggagggcagtaaaagatgaagttacaggacccccattctccattcatcctagcagatctcaccatccatcctgagcctattacatttctacagctttctttgggcttgctgttttctaaattcaaccttgcagcatagtgcatacattggtatacagcttaaggtgaggactttatgcacacacacacacacacacacacacacatacacacacacacataaatatatatctcgtacacacacacacaccactaccttagtacaattttctatacagttcacatatattcagatattagctgggctggtctttacgtctgaagttcttgactttcacctcaccagttcaagacccttgaaagtcttgagttttcaaggaatttttctgatttcccagggcttgactctctcagaatctcctctatcctcatctcaagcttactggcataatgtatttttgtttttgtttttatttggttttgaagagatggggtctgtcttgctatgttgcccaggctggcctcgaactcctgggctcaagcgatcctcctgcctcagccttcctagtagctgtgactacaggcacgtggaaccatgcccaacttataatgtgtttttaatgtggcttttttttttttggcattaacccagacatagaactcaactaccagattattctcaagtttacccaaaataatctattttcacaaggaaaccattactgatcagtatagcccctacattaaaggttttataagtgatacaagctggagaaaggtgggagcacaccccgtagtagacaatttaaaagccattcttagtaattgtcctctatgtcccttttgggctgctttgaccagagacctctcaaacctcccttctgtactcatgtggtgccgccactaggttgatccctctcttccatgacacctctagcccgtaaatatttaacttttttttattagctagtcatactgggcaattcaggtcttccaagttcaggccccaactgcctacaactgaactggaaagtgagtgaggttatctatttaacaaaattctatgtatatatatatatatacacacacacacacatacacacacatatatatttattatactttaagttctagggtacatgtgcacaacatgaggtttgttacatatgtatgcatgtgccatgttggtgtgctgcacccattaacttgtcatttacattaggtatatctcctaatgctatgcctcccccctccccccactccacaacaggccccagtgtctgatgttccccttcctgtgtccaagtgttctcattgttcagttcccacctatgagtgagaacatgcggtgtttggttttttgtccttgtgatggtttgctgagaatgatggtttccagcttcatccatctccctacaaaggacatgaactcatccttttttatggctgcatagtattccatggtgtatatgtcccacattttcttaatccagtctatcattgatggacatttgggttggttccaagtctttgctattgtgaatagtgccacagtaaacatacgtgtgcatgtgtctttatagcagcatgatttatattcctttgggtgtatacccattaatgggatggctgggtcaaatggtatttctagttctcgatccttgaggaatcgccacactgtcttccacaatggttgaactagtttacagtcccaccaacagtgtaaaagtgttcctatttctccacatcctctccagcacctgttgtttcctgactttttaatgatctccattgtaactggtggaatgggatctaattaaactaaagagcttctgcacagcaaaagaaactaccatcagagtgaataggcaacctgcagaatgggagaaaatttttgcaatctactcatctgacaaagggctaatattcagaatctacaaagaactcaaacaaatttacaagaaaaaaacaaacaaccccatcaaaaagtgggcaaaggatatgaacagacacttcgcaaaagaagacatttatgcaaaattctacttcttgtgagagcagttggagttatacagagcaatattttgatttgttttgagctacactcatgtttacttgctctgtgaatggcttactgatttttctcttctactttctaactttacaccaaaaccactattagctccccactatttaaaaaaaataaataatgaggtcaaacatttgttgttgtcatgggcgacatggtgtgtactggtgtgggtgtgagagtgtgtatgtgtgttttgctgtgtgatccaggcatataatagacttctaatacagcttcactattaagatgacaactgctgaaattcagtactgccttttgccctctctctgatttccttatttctctcttagtgtatcagccatgggaagacccaatctttcccttacttatgatgcatctttactggagttgacagctcctttctttgcccatattctcctgcaacacaagtttgtccatagttccatcccctgagaaaacttagacttcaagctgtacccccttatctattatctcttcagtacagaatttcattctttttggaaaattccctccacatatcctagcatctatggcattgtcatttgtggactgatctggccctgacttgtcctaaagcctcattactcttctattaaaaaaataccttctaactttgaaggagaaggaaaaaaaaaagccactcctgatagagaacatcagggtgatagaagggactataaaaatggctcatcaactttattcttcaaaagtatcactataatggaagaaaaaaatgctggaaacttttactggttaaaggatactgtagtaaagagatgtgataactaagtgcagtatgtggccatagactggatcttgaagtggaagatgtacagtgttgtaaggcatattactgggtgaattaacaacactgaaacacagccagcagattagataacatttctgtacaaatataatcatgcaccacataatgatgtttctgtcagtaatgcatcacatatgcatgactatggccccataagattataatgcatcacatatgcatgactatggccccataagattataatactgtatttttactgtatcttttctacgtttaaatttgtttagatacacaaataacattgtgttacagttgcccacagtatttgggacagtcacatgctatacaggtttgcagcctaggagcaatatgctatcccatctagcctaggtgtgtagtaggctatatcatttaggtttgtgtaaatacactctataatattcccacaatgataaaattgcttaatgatacatttctcaaaacacatccttgtgaagtgatgtgtgactcttttcagttcaatgaagttagtaactgtactatgggtacataaaaaaatgtccctgtttagaggaaatactgaaatatctagatataaggttcatcatcatgttgtctgtctcaaatgttcagggaaaataattatatgtataattatagaaagtgaatggggccaggcatggtggttcatgcctgtaatcccaggactttgggaggctgaggcaggaggatcacttgagcccaggagtttgagactagcctgggcaacacaaagagatcccatctcttaaaaaaaacaaattagccaggtgtggtggtgtgctcctgtagtcccagctcctcaggaaactgaggcccaaagatcacttgagcctgagaggttgaggctggaggaaaccatgatcgcgccactgcactccagcctgggtgacagagtgagaccccatgtcaacagaaaagaaaggaaagaaatcaaatgggatacagtgttatattaataataaattgttattggttgaattgtgtccttccaaaaaagatattttgaaatcctcaccacccgtccctcagaatatgactttatttgtaaataggattgttgcatgcgtaattaatttacataatgtcatactggagtagggtgggcccccaacccaatatgattggcatcattataaggagagggccacgcaaagattgacaggcaggcaaaatgccatgtgaaaacagaggcagatattggagttatggagctgcaagccaaggaatgccaaagtttgttagcaaaccaccagaagctatgaagaagttttcgtgacaaattttagagggagcatggccctgctcacaccttgatttcagacttctagcctctggaactgtgagacaataaactctgttgttttaagccacccaatttgtagtacttggttgctgcagtcctggaaactatatatatatatttagattgtagtcaccttgctgtgcggtagatctcaaaacctattcttcctccagtctatctgagactttatatcctttgatccccattccctccttccctacacttgcagtctctgggagctatcctactatccttatactctctgcttctgtgagttcaacttttttagattccacgtgtaagtgagatcatacagtatttgttattctatgccgggatcatttcacttagcatgacatcctccagatttatccatgttgtcagaaatgacaggatttcattctttttcatgtctgaatagtattccattgtctacatattccacattttctttatctgttcacccattgatggatacttagcttgattacatattgtagccattgtgaaaaatgcttcaatgaacacgggagtgaagatgttcctttgatgtattgtttcagttcctttggatatataaccagcggtggtatatattcctggataatatggcagttctatttttagtttttcaaggaacctccatattgttttccttaatatttggaaataactgctattctgatgcaatatagaattttgtagcctaagataagacatatgggagggaaattagcatgtgtttctaagtttggttacctacacaggaagagaaatattcaacacctttacatgtttggcacttgttctgattccagaatatcggtaagcccaccactgacaagtgtcactctgggaatcacatggctattctattcctggaggtttgccatcaaaaacaaaggagcttggcttcctaatattttaagagaaaatattccgtgacacttagttacctagtttggcttgaagcagcctaaagcatcttctaaatgaacttatttctggagatggaattacattcttggcaggaaataaaagaagtcaactttctctgtgaattttcagtaaggattgtggcattaccttatatattgttaagcttttgataaatactcacatgtttgtctgatccatttttgagtataaacttctggaaaaaatctagagatgatatagaaataaataaacttctgcaggtcctataacccatggtatctatgcttaatgaaaattcagaagaccctaatttatacaaagctgttatgtcatctcctaattatattctgtaaagggaacaggctggaattgatgtctctttgctgtttttcagatactctgacttttttgtgttatttggaaaggactgatatgaggtatgtgtgtgaagtgctgattgtggagagaattttcaaaagtggtgtgagagtgtttgttgacatggccaactttatatttttacttttctgtgaaccctactgtgaatcctggcttctatcatggactttaaaatcttttacttaaagtataatctgagaacatatttgttcttttattcattggttggttggttcaatagactctttgtgcatttgttcaatccttcattttatcatttcttcatcacttaattatacggccaatacagaaagtatttattgagcatctactatagtgctagtcatgtaacctctgatttattttccacaatttttgttggtaccattcattcatcattcaacagttactagtacgtaccctataccaagcataaagaaatatagacaagggatcttgctggaaggccgttggctttgttgactggggtgtgttatgtgtgaatcactcctatcttgtttatgctctaagcagtgatccatttctatcctatgaaaaagaaatgcctgggccgggcacggtggctcgctcctgtaatcccagcactttggaaggccgaggtgggcagatcttatgaggtcggaagttcgagaccagcctgaccaacatggagaaacctcgtctctactaaaaatacaaaattagccaggcatggtggtgcatgcctgtaatcccagctactcaggaaggctaaggcaggagaatcgcttgaacccaggaggcagaggttacggtgagccgagatcatgccactgcagtccagcttgggcaacaagagcgaaactcggtctcaccagaaaaaaaaaaaaaaaaaaaagaagaagaagaaatgcctggactcagaactatttcattagcaaatcaaggaagaaactttcttgaagttatagcgactattaaggaacctttacaatttggcatcacttccctagttctctcttctccatactggccctgggcctctactgctctttctagctttctgcggatgctctgtttacctggattcatcctgtgtatgtagtggagggtgatggcacacttttaaactgcaaaagctgtcattttcttttcattctttcttgatttgctagccggaattaattgatatacatttatgaaagaagaagcaggaaagaatccgtatgaattattctgcatttacaatttattgagtacatatcatgtgccaggatcatagttcagtgccttaatgcactacatttctggtaatctgcaatataatcctgtggggataggagttgcttttttcattttataaatgggaagatggagactcataggctttgtcagtcttccatgttaaaatatctcatcaatggtcagatctggatttgaatttcatgttttctggcataaattttctgctttcagctgtatcctaaataaaaaataccagtcttgtgaaaaaatgagagatgatggatatagatacatactttttaaactagagaattctgtccaggcacggtggctcatgcctgtaataacagcactttaggaggctgaggcagttggatcacttgaggtcaggagttcaagaccaatctggccaacaggtgaaaccccgtctctattaaaaatacaaaaattagccaggagtggtgttgcatgcctgtaatctcagctacttgtgaggctgaggcaggagaatcgcttgaacccaggaggcagaggttgcagtgggctgagatcacaccactgcactcccacctgggcaacagaggaacagaggcaacagacactctctctggaaaaaaaaaaaaaaggagagaattttggcaatgtagaattctcttgacgggaacagtatagcagatatttcagtttcagcacatggggttcctgattagtgacaaattcatattgaaccataaatctgtaatactgtcatacaaggagtaaaatgtagttgtcttcttgctaatgctccttggaaagtttcagtcttttcctattaacttggttgctctcagttttattaccatttgaaatatatatcttctcatatcacagcaaaaaataatgactttggatgatgagtcgttttaatgtttgaacagaattacacatagaattcaaactgttgtcagctttcaagtttgtattatgctgtttcctagcaggtacatgcagactgaaagtatttgtatcatgatgatttttactaactttacagtaattttacttatgactttacttatggttgtgaaatcatacagagatatgttatatcagaatgtcaaaatgcttgttttaattaagatcccagaaaatatttatttccaaatatccaaatttataaataactttggagctctgaattagcataaaatcagtcaagaagaaaaagagagtataaaaaaataaaatatatttcctcctctcccttccccatcatcagggactttcatagaatatactcgagacttaatctgcttcattttgaatttcattttcaaagctatttctttttcaggctgcccattacactttatttgaaaaccagctcttatcatttagtcattattgtcacagatcccaagttcttaaattatgctcatcacaaaagatactagttttatgttctcatcccattcaggggctattccaatataccagccgagggccacattggtgacattcagcacagatgacagcttttgttctgagcaggcacacaaagaaatgactggggaagccgaatcatcgtttcactaaggcaaggaagaagtgtctttctgggtcatgcagcccatggccaagagatgtcagaatacctacagcaaacatataagcagtataattagctcattgtctctagctgggaggaattccccctcacttggcattattaatccagacctcctaaaggccaaagtgttgatagcctgcagtttgctgaaatacatattgaactatgcattcttcaaaatgcagctttagctaacctcctgcatgaaggattctgtgactccaccctctacttccttcttcccagttgtattatgttcctaccactattctggcatttctcacgtgtacttttaaagtgtgtgtgtgtctctgtgtgtgtgtgtgactctctttttgattgtgagtttttctactgcagagatccctccgtaccttctctccccctgtccctaccatatttttattataaatatttttatagattgatagctttgaaatgattggattttagcagtataatagaatgaaacacctggattctgcttctgactccatgagtacagggagtcattgaataatgattcgttattatttaatgcttttatttaacatgtgctaattgagtgcctcctatgtgccaaactgttctggtgctgggaatatagtgatgaacaaaatagtcaaaatatagacaagacaccgctgttctcctagagtgtgcatttctgtgaagaagacagacagtaaataacatagcatgtaaataatcaagacaaacacccaatacatggtatgcagagaattaaaacaggaaatgtgtaagttgttactttaggttaggtagttggtgtagctgagatctgaagaaaccaccaatgaaggttaaggacgttcttaacagagggaataacttgtgtagagactccaaagtggcaatgaacttgtcatattctaagcatatgaaggtcattgtgatgagtatgttggatgaagatgagctatcagagaaataaaaaagatgagtggtttggattttattcttgatgcaatgggacagcattggagactttaagctgcacaaggttatgatttagtttattttaaaaacattacccctgcagtatgtaaagaatggattcacgaggataaagagatggtagggatcctccgtaggaagttattactgtagcccaagcaagagatgattcattgttctatgtggtggtagtagagatggagatgggtggatagattttgagatatgtttgagatagagttaaagatgtgctgatggtttggagaagttaagtaaggggagaaatcaaagtcttagtaaactttggtaagtcacttaaatatttctagtaacaggcccttcataaaatggggattacagataaatcactggttcccaactgagagcaactttgctcctctctgtttcctcccgggacatttggcaatttctggaggcatttttagttgtttatgtgtgttgagggggaggggttctattactaacattggtaagtacaacccagggtccaaaacatcttacaatgtacaggaccaccccttcaacaaagaatgatctagcccaaaggtcaatagtgccaaggttgagaaaccctgaaatagcaccttacaaggtggttgtgaggaccagctaaattaatatattttaaagcaggatgaaagttttaaatgctctgcagagacaaagtgttattgatgcctcaattttacagtgtctgttggggtaaagataattcattcttgtagttccaaagaatctcttctctcctggtcctgaatgaatgtggtgcattttgaatgtgatactttgggccatagcccccttatgcttcagtagagaagcagagaagaattgaaaatttgggcttcaagaatttttttgactccactacagccataatttaaaattttgtggtagaaagtctggttataaaattcactagaaatgagttttaaagtaaacttatttttaaaaggaagtagtgggtgggtgaatgtgagactttagggggattgtgccaccttttttccctgagaaatgccaagggaactaattaaagaagctgaagggagagcaaaggcacgaatagagtagcctattctccattccttctgtgtcaaacaccccacgctacactctacactaagctcttgttagtaacctcccacaggacagggcatttgccctccagaaagttggaccttaaaatgagggaaacaagtaactcttacctgtaattagcttcaagaatactccctcaaatgaaagagaagttaaaaaaactgcctcaatgagttcttaattgggtacaagataatgttggtagaagtttaaaatatttaaccagcagtaaatattcaaggcagtcatttgaagtaatcaatagctaggtgaatgcatacattagctggcagagaatcacttaatcaacagttcaaataaacaagaggagaattcaaaatgcagatctgaaaatacagagaattagcaaagatgctaattacatccaggtaccttcttcctccagtgactacttaaacatttgccaaagtattgctaaaaataaccagttctgaaaagattcatttcttttcagaagagctgcttacttagagagtgattgatggccaggtccagcaggcagctagaagtacccaaaaatgaagtgctagtaggtgacctcacaataaaaagccttgagaatccttcagctggcatgcgctgctggcaaaaaaggatatttttttaaatttttatttttagtctttaccacttaaaattttcagacttttctccccgcttcagatattatatgatagattttatcagatagacagtgagccatttatgataatatacagaaactgacataatgcatgatttggttcatttaaaaaaatcttacttatcttcttttcccaatccttctcaaactcgtctacacttcccacatataaaataaaatatattaaaaaggcttaaatcttacacaggaggctatttttagtatctccaactagaagactgaagctcttaactcatctactagagtcacttgttagaaggagactttcctacaggcatttttattttgctttttgaaggaattatgacaccccctccccaccaccaaagaattgctgtttctacctctagcttcagtagccattaagcagttcttcattttgaaggatacatatagatccagaaacattttctggttggagaaaaagtgtgtattttcaaggttccctatctttaaggttcctagttcttattaaagtagcaggataatcagcttaatgggtggttgcttacgctttctgtgggaaaaccatgggggtgggagttacaagtatttgttctaatttcagcctcattactaactagctgtgtagacttgggcaagtcatttaccttgaatttcagcttagaggcaggattgttaaaataggatcaatttgtaactggatttgaaacctgatcagactattagaaccctactcaagacttaattactgagtctaggtgtttccaaagtctcaaggtgatggattcttttacagccagtgtttgtgcatcactgataattcattcccttcactttgcagcactgataattcattcccttccatttgcagactatagaaatttaagtttcagagaagcttagtaatttacttaaggtcacatagctagataataatgaaacttgaactttaaatgtaacttactgacccccaagatattgctgtttccctattattaggtgcttatttaaccggagaattgccatgtgttttttgtaacaattacattttttttttctttttgagatggtgtcttactctgtcacccaggctggagtgcagtggcgtcatctcagctcactgcaacctccacctcccaagttcgagattctcctggcttagcctcccaagtagctgggagtacaggtgcatgccaccaagcctggctaattattttttttttttttgcatttttagtggagatggggtttcaccatgttggccaggctggttttgaactcctgacctcaagttgtctgcccgcctcagcctccgaaagtgctgggattacaggcgtgagtctctctgcctggccacaattacaatttaatattaaaatatatacatatgtgtatttctatacatgtgtgttgacttttacacagtatttaacattttcaggtgtgtaaaatgaaagcattaggactaaatgatcacatagtgactatttggctcttttagagagaatgtgaatcactacctaccatttcactgatgcacactgtttaaaagatactatgctaggtgttacagttagaccctgagaaatggggtgctactatgatgttgttatgatagccatgcatgtgaataatatccagattctgcttggcccagatacctctccttcctatcatatttctgggagaaatagatgcttaaaaagggaaaagaaagcaaagtagagcatgttatatatacctgggtctttggccaaggtacaacagtataatgtcatgggccatgagaaaggctctattttctctaagttaattagagaaaatgtacctgctccagtacgttcctgaatagatgtatccttatacctttgtagagggagcaggcactaagtcagctcactactccaattcatcatattgggaaagaaaaaagagaaaaagctagaacatatccaggtacattggccttctgacctccttgaaagcacaactcctaagaggtgtggcccaactaatgctgtatgattgtccaaaccagatcaataacactccttttggtagaagccagtaaacagaatgttgagtataacctgtttatacagatgagaaatctgacacataagttcaaattacaggcctaaagttgcttactgcatatttcttcccttttctttcatagcttcatatatgtgtatatatgaatatgagtggtatgagtgtatttcaaacatacatatatattccaaagattatcatgtaaatgtcataaacaattgtaacatttaaattcttaaatttaatagtaagatatgttttataacatgtatctgagtttttatattcattcattgttatattccatcaggagtcatgtgaatacttaaaaatgcagagcaggtaacttttaagatctttgattatacactttaataaataggttcagtaaaattcacatttcttgacatattcattactcagcaagaattgcatacatctttttaattattcccaaacattcaataccttcaactcttaacaatgaattaattcctttgaagttattatacacatttaataaaattatatgtaactacgcagaaaaataatataagcttctcttttgatcctaaaagtagctaattcaactgtttctttctgcagttgtaggaattgttcacagattcttcttgaagttttgcacttttgtgtatctctacttgttttattggttaagcaaagtaaaacttctgaatggcttttgaaactgtacacaaaactcataaacacaacctttaaacaactattgttaaagtaagaaaaaaacaattaacttataaatctttttcctcttttcagatgtaggtcacaaaggagaaatgctcctctgttaatttttgtttttttttaaaagaactgttggttttaaacttctttttagcctactcactattctcaaaggatgcaaggcccccccatgggataaagtcagctttgtcagaggaatatcagcatgtcagctcctgaagaaccacttggagtttgaatagtaacttattgagtggataattgagaaagctgagttaggacaggatttctggccctaataacatatgaatgtctcataattatcagtacagaatcctatgaaatctaatgcttactttgaaacatatttatttaatttatatgtaagtatttatttatttgtactagacagatacaggttgggaattacttaggttttgcttaataaaatagttacttttttcaaaaacatgaattatcttttttctttttggtgagaagaggtcatgtaaacaccaattgtctagcaagatttttgtattgctttttattagggactgttggttttaaattgctttttagcttactcatcatacttttaaatacatggatagttttctgccatatccaagatatttttaataataaaaagtttttttatttctaaatatcaatattattatgatttttttccaccagtgaaaaaatacagtgataatgcagggaagtataattactaatttattttgtaatataattataaaatatatgtaatataattataatatacttaatattttgtaatgtaattacaaaattaaacctaattttatacttctttgaatattttgggagtcaggtggtttttctctaactcaaacttctaccagagacttgggatcccatgaactgtagggacttctgtattcctggaactggtttgggcctcaaataaaacctgctcaagttctcactcaatcgtaagctcccaaagggcagagatgatgtctctctgattttcaagggactaacccagtgacaggcacagaatggccatttagtaatgaatgacaagggtgctcatgcaattttaaaacatagtccctcagcttttctgcctttgagtccaataagcatactagaaacccagaacgaagctagtaatatttgttccagtaaagtgacatgtatatggttttcaaaaaaacagctgtttgttttttttagaagcataagattattaaataaacttctgtaatgagtggataaaatggtgtatcctatgaaaacaaccaaagaatcactgaatcagcagttctgaaagataaaagtctcattttgaggaaatgcaaaacaactgaatgcattttattactttgcatttaaagtaggaaggtggcaaatactcggaagggtattccagttctgtttctttgtaggcagttatttttactgacaggtgagagtgtttcacctttatttgttttatagatacaagctcttacaatgttctttttccttccatggaccttctcctcttctatttcttaccaagtaaattattgaaacaaggctattttgaggtaaaacgaggaagagaagtaatacctcactgcaacctctttccaaacaatagggaaacatcaaagttagggtcaaagctaatactgtcaacttataaaagagctcactcatcatgtctaactttctttgacagtatctacaaaggcttctgtatctagggatgattttattgtcaatatgcaatcaggcaggtcaatgttcatttcatttgtgaagaaaactacatcaagcaaatttcattataaaacctaaaatcaatatacatttgtgtcagtgttctctaaataatgaatgtgaatactccttcaccctgaaataacatttttaaggattggatttttctgaaaaaaataagaagacatatttggtttttctttgaacaatatttgcacttgattctaagacagtgataccaggaatgacttttggagtcggttttgttttaaatatgtttattgatcaattatggcccctatacaagttgagactgactcgagtaatgaaatattcagacctatcaactggtaatattagaatagtgataataagcatagctagtatttgcttagtatgcattatttatggatactgtgaaggaattttctttcatttttcacatttagtctttgtaaactgccttaatatagaaatacaatacagggatacctcatccgattgcagtttgcattactgcacttcgcagatactgcttttttttttttttttaaagaattttaaggtttgtggcaactctgagttgagcaaggctattagtgacatttttccaacagcatatgctcactttgtgtctctttgtaacattttggtaattctctcaatatttcagactttcttcttattattatattgttacagtgatttatgatcagtgagctttcatgttactattgtaaatttggggggtgtcatgaaccaaactcataaaagatggtgaacttaattgataagtgtagagtgtgttctgactactgcagctaccagccgttcctagtctctctgtctctcttaggacctccctattctctgagacacaataatattgaaattaggccgattaataaccctccaatggccttgaagtgttcaagtgaaaggaagagtcatacatctctcactttaaatcaaaagctagaaatgattaagcttagtgaggaaggcatgtcgaaagctgagagtaggccaaaaaggtaggtctctggcatcaaacagctaagtcgtgaaaacaagggaaaagttcttattgaaaattacaagtgaacagacaaatgataagaaagtgaaatagccttagtgatgagatggagaaagtttcagtggtctggatagaaggtcaaaccaaccacaacgttcccttaaagacctaaccctaatccagagccaggaacgaagtgtctaaaattatgtgaagatagagaggtaaggaaactgcaaaaagaaacatttgaagctagcagaggttggttcagaagtttaaagaaaccagcaagtgtgatgtagaagctgcagaaatttatgcagaagctctagttaagatcattgaaggtagctacaccaaagaagagattttcagtgtagatgaagcatccttctattggaagaaaatgccatgtagggttttcatagttacagaggagaagtcattgcctggattcagagcctcaaaggacaggctgactctcttgttaggagctaatgtaactggtgactttaagttgaggccaatgctcattgaccattctaaaaatcctaggaattattttcaaaatattactgctcatccacaatgcacttggtcacctaagagctctgatggagatagacaagattgatattatctccttgcctgttaacataatatcctttctgcagttcattgatcaaggagtaattctgactttcagctctaattatttaagatatatacttcataaggctatcagtaccatagatagtgattcctctgatggatttgggcaaagtaaatttcaaaccttctgggaagaattcaccattttctatgccataaagaacatttttgcgaatcaaaggaggagcccaaaacagcaacattaccagaagtttggaagaagtttattctgaccgtcgtggatgacttacagaggttcaagatttcagtgcaggaagttaactgctaatgtggttgaaagagcaagagaactggaattagaaacagagcctgaagatgggactgaaattgttgcaatctcatgataaagttgaaatggataaggagttggttctgatggatgagcaaacaaagtgattttctgagatgaaatctactcctggtgaagatactgtgaacattgttgacataacaacacaggatttagaatattatgtaactaggtgataaaggagcaatagagtttgagagaattgactgcattttgaattgactgcatttctgctgtgggtcaaatgctttcaaacagcaccacatgctacagagaaatctttctcgaaaggaagggtctatctatgcagcaaacattgttgtcttattttcagaaatggccacagtgaccccaaacctttagcaaacaccaccctgattagtcagcagccataatactgagacaagaccctctaccagcaacaaagattacaactcactgaaggctcagatgattgttagcattttttagcaataaagtatgtttaaatgaaatatgtacattgttttttagacatactgctaaaaaacaatgcacaccagatagcctacagtgtagtgtaaatgtgacttatacacacggggaaaccaaaaactttgtgtgcctcactttattgtgatattgttctgttgatctggaatcaaattcacaataattctgaagtgtattcctgtagcctgggtaggctaaatgctataagcaatagccccccaaatctcagtgtattaacacaatagatgttttaatatcgcctagcagctgaatacaaatgtatccttctatttgtggcccactattttacagagcctctgagtcctctgctatgttcctgtcaatctcacacaagaggagagagagaaggtgaggatagcacagatcttttacatgagtgggcactgggagaggcacctatctcttcatccacattccctttgggaaaacccatcatttggttacatctaactgctaaggagcttgggaaatataatcaagttggctgatcaagtagctatcctctcccataggtagtgttatacccctttatagatgatgaaactaagacttaaagttcaaacagtattccataccatcagcatcatctacgtgtataatggtaacactgagtctccctagtaacaaaaaaggtccctgttttttaagcactgtggtctccttcaaccctgtgctgggtagtttgccacttactatgatttaccctggaaacaaatggtatcttcccattgaaaaggctagctggggagatgcacagctgagattttgactttatgttttattcagggtccaacgcttgattttgtagtagctctattgataaagctaaaatttaataacagaagtaataagtacaacttctggggaaaattttaagaatcagttggcaattcctgtgctccttctttcctcctattatgaaacaggcagtgttctaaataaagctattctgtcaaactgggtccgtattgactttgataagcaagtgctctctgtgggcccatattggatgtgtaatatgagtaaaaaactttccataagtccccgagagctttatttttattttattttgtactggtattattatcaaagcatagcctagcctttcctggctgatacacactttagcctagaatctctactttcagtgtcttacaaaactatttaccaaggtgtgtaagatatgtatgtccctgtatctatttgtctatccaatgttgttcaccagagtcttgtttaataagttatggttgagagaattatgcttgtccatacaatggaatatgtgaagctgattttaaaaaatgatatgatagatctgtatttacctacatgaaaagatgaccacaagccatgattacatggaaaatacataaaagtatatgcatgatatttcacagagtaaataaaaacttattattattgtaggagaatagacttcccaggaccctgaggagctggaggaggtgacagcacgctgcaccattcccaatgtagtccaaggttccggcataccattgtctgcctaaatcaccaagttagcttccttaatggtctccttaccttcagtcttggccccctccagtacattttccacacaatgtagccagtgtaatctttataacagatgattcacctattaaaaaattggggattatctccattgatagcatgtaaaaatccatgtcttagccttgggttcctaaaaaacagaggctaagacaaaacttaaatgttaaacctttcctgggatttacagtccaatgcagcaagagtgagagtctcaactttgcttcactcttctctatggtaagactcatctgtctcctagttgcccactttgtttcacggctttcttgacatcttttgtctttttgaatctgcccatttccttcaatacatcaaaaggtctttggaagcaaaggcgttttgttattaactgttgtatcttcagaaataaaatcatagaagaaaaacaaatcatgatgttttcaactaatgtttgtcaaacaattatgtttagcccataaaacaattttcctgataattgggttttcagagaattcttgaatcacgcagtgtgtattaggccatttttgcattgctgtcaagaaatacctgaaactgggtaatttgtaagaaaagaggtttaattggctcacagttctgcaagctgtacaggtggcatggtaccagcatctgctcctggagaggcctcaggaagcttttacttatggcagagggcaaagtaggagcaggcacatcatatgtcaaaagcagaagcaagagagagtgtggcgggggttgggcgccacacacttttaaatgaccagatctcgtgaaaactcactatcacaaagacaacagcaagccatgagggatccacccccatgatccaaacaccccaccaggccccatctccagcactggggattacaattcaacatgagatttgggtgaggacagaaatctaaactatatggcagcatctgttgctttagttctgcctttttctgtaggttcagagcaaacttttcctaccgtatgcgttgtgtagttttatgtcactctatgccccacattgattttcttcccttatcaatagaaaactatgtgtacgttttcctacatggattataataaaccccttttaaaaaattttcatatataaggcattctaaaacctgtatgataacacagatttgtctgtaccaactactaatgaggaatttaaaggaaaaatttagtgaattcctcacattgaatttaaatttttattttttttcttggttgttagtttaaaattttgaaatctcagtctgtagcattcttccacatggccagccgtgacgtgactcatgagtcaccaacccatttagtcagtcaaattatttaacaagcatttaccaagtattctgtatgagcagacttatggataggctaaggccaactctctgacatatactgtatagggtatgtttttaaaattttccctacattaatttctgttgtcatttttgcatttagctcagtacagatattctgattctgatgctttaaaactgttcctttctctttctttttttccttttgagatggggtcttgctctattgcccagacgggagtgcagtggcacaatcacagctcactgtaaccgcaaactcctgggctcaagcaatccttctacctcagtccagaatagctgggattacagatgtgtgccaccatacctggctatttttttttgtattttttgtagagatggggtctcactatgttgaccaggctgatctcaaactcctaacctcaagtaatcctcctgtctcagcctcccaaagtgctgtgattacaggcatgagacaccacatcagacctcctcatcatgttgaaactcttcttgaatggacttaaaatgcttctgtattagtctgttctcttgttgccaataaagacatacgcaagactgggtaactgacaaaggaaagaggtttgattaactcacagttccacatggctggagagacctcacaatcgtggcaggaggcaaatgaggagcaaagtcatgtcttacatgacaccgggcaagagggtttgtgcaggggatctcctatttataaaaccatcagatctcatgagacttactaccacaaaaacagtatgaaggaaaccaaccccatgatgcagtgatctctacctggccctgcccttggcacatgaggcttattacaattcaaggtgagatttggatagggacacagccaaaccgtatcagctacctaccaatttttaaataaactttaatttagtttaaaatagtgttttttcaattgttgcatatttgaattgactgaggactttaaaaaatggcagtgacatatccctgctcttagagattctgatttaatttatctgagatgagaaccaaagatattttctaaattcaccttgtgcaattcccatatatagcttgggttgagatttttgactgaaaataatatttcccaaaatgtgatccacagatcattggagatttttatgaatctttgagctcatcagagcgctcatgatattaatgtggatttttttcctgaaatgaaataatgaatttttcatttttaaacctcctaagtatcttctcagaatgggcatcaatctcataaatgctgtggtttgtttggtgttagttagcaagttaggaatctggttcactgaatgaaattactgttttaaagtatcagaaaggacacactgagaatgttggagttgagagttttagtcaagcacatttaatttatggatgaggaagttgaggccagagaaatgagatgttttgtctaacttcacatagctggtctgttcaacactacggagaatctggggctcgtaactttcagtccaatattctttctgctttatttaccccttgcctccctggagccttgtcataggcttcaggcttcacttgttccctctgagccatgtcctaaaaattccaccatttgttattttaatcccaatgctaaattctaattaccattcagtgaattactgtacagtaagcagatgtgtgttattttctaggggaaataaaaagctggaatgtgatctacacctgtaccttcagcagtgtttctccaccaagaagtagcaatcagcattaatatataaactcaagttgccagagtctcaaatgtagcatatgcagagtgcagggtaagggtttctcttgccaacagataaaatgcactccaggctcccattggtgttcgcaaatgccagtcaccaaaagtcagctttccccctgaaaagcaagttttgtttttgcacaattaaatggtaccttggtgaaatgagatagagcctttctcataggaagtgatttttctgggagcataaagtaacaaaatgaatctgttgtggatgtgtttttgttgttgttgttttcttatattgcacacaactttttaaaatgacagaagttggaatgaggttggcaacaaaccacgatgggctcattggcatgctatagcccttattgtgttcagaaattaggatagaaaatgcttggaggcttatttcgtactgtgattcattgcatcatgtcatctagtggagtattatgtttgtttcattctaatttcatggtgataaattctgtacttttcccacctgggcttaacctaagtggtctccatgattgggaggagggaatgattttttaaatgtatatttgctcaagatttgctcctggatctcctgaagataaggtgagtaatgtggtgaaagtacttcctctcctgagtatggaaatctggttcagtggtagcttaaggggatacacacttcaattgaagtctgaagcctgcatatttctacatcctcaaacaggttagcacttcggagcagtggggggtttgtctctcaatttagacacctgatgagtagattatagtgaccagtttcaaatatgtcttcatggtagtcatccatgatcagacaaatgatcagatttccgtgtatttaatattgagtttttataaatgtctgtcattttcttttcttgaaaggggtgatgtccatgcctccatctttcttttacctttcaaaaattagtgatggtagcaaaacagacagtttctcagattgaaggagaggaaaattatgcatgactgaattttgacattatgagttgacatcacagcatacatcctcctaaagtacaatttgacaacaaaaaaatcacaaggtcagaaagaaaatcatagagcccatccactcaatctcttgaaatcaatcataatgatcaagtgaaaaccatcaaacccttaggtaggatagcatatctgtgaggagagtgttaggctgcatcccagtaggtacattaaaaaaaatctcagtgagtatactctttagcattgttaaatataatctgatattcttatttaatagtgattcagaatattggaggtcactcaaaaagagaaagttttgcaaagaagaaaatactctttcgggattttaatttttaaaactaaattataaatattcaaaacataatgtacagaagttgataccaattcatatccatgtattcacagcctttgaaaaaatgggattatcttgctttaggttcagtttagttacagacgcaattgaattcttaaactacagatacaaacatatcctttctcacctctatctcttcttttctgcctcttcagatgtattaaatattccaaagtgaatgtttccttcttattcatgagtttatacttttgttacaaattcatttatcaaaaaatgtatagtatttggtggtgttaacatatatttaaatgacatgctataatacaatatccttggctgctggcctgcttccccctgtatttgatatgatcaacatggattctagttcatttattttaaatgcagtgtaacactattttctgactgcaccatgatgtatttacctgttcttgtactactgggcatttaagcttctttttgggaaaccacagcagtgagtttttcctggtatatacagcctcctgatataaacatttctctagggcatattcccacagatgttgaatcactgggttgtagggtacgtgtgtcaactttactagtattgccaaattgttttctgaaatggttgttctaatttatattcctaccaacagtgttaagagttcccttaggctgggcgcagtggttcacgcctgtaatcccagcactttgggaggccgaggcacgtggatcatgaggtcaggagatcgagaccatgctggctaacagggtgaaaccccgtctctactaaaaatacaaaaaattagcccaggcgtggtggcatgcgcctgtagtcccagttacttgggagattgaggcaggagaatcacttgaacccaggatttagaggttgcagtgagccgagactgtgccactgcactccagcctgtgtgaacagagtgagcctctgtctcaaaaaaaaaaaaaaaaaaaaaaaagagttcccttaaacttctacacttttggtgggagtgtaaattagttcaaccattgtgaaaagcagtatggcaattcctcaaagaactaaaagcagaactaccatttgatccagcaatcccattactgagtatatgcccaaggaatataaatcattctaccataaagacacatgcacacgaatgttcactgcagcactcttcacaatagcaaagacatggaatcagcctaaatgcccatcaatgatagattggataaagaaaatgtggaacatatacaccacgaaacactatgcagccataaaaaaggatgagattatgtcttttgtggcatcatggatggagctggaggctattatcatcagcaaatgaacactagaacagaaaaccaaataccacatgttttcacttataagtgggagctaaatgatgagaacttatgaacacagatgtggaaacaacagacacttgaggtctacttgagggtggagggtgggaggagggagagcagaaaagataactattaggtactgggcttaattcctgggtgatgaaataatctctacaacaaactcccgtgacatgagtttacctatgtaacaaaccttcacatgtaccccgaacctaaaataaaagttaaacaaaaaaagaatgcaaaacaaacatgaatcaacacctagaatgagtaattacatgagcatgttaacaatattaatattttgttaatgaaactaagggtggtggatttcaacccccaaattttcatagtgtgtgttacttttataatggaaaatgtcccaataaactatttttaaacctaaaaaaaggagttcccttaatttgcttatagttgatgttatgccctggctggttccagtctgcatacccctcctcactccatagttacggcctcttgaaaagtcttgcggtctcagtcttatcaacttttcttgaacagatattgccctttcttagcaggtttgatggagctgcaatccactaccctttagctcattggtgggttgtgcctgctgcaagtttgggttttattttatgacttcaaataactagacttctcttttatattaaaagctcttggccccacattctgaaaagtagatctttctactctatctcagctgttgctttaggatcctacatgaaatgtaggatgagactttatctgacttaaagtttctctcccaaggattgaaattcagcctctgaaattcagtctgcttcccgggactttgattgatgctcctgggcttttctgtgacatgagtcttcctcctcatgcttcaacaaccctctcttgtctgcttttggacttctgtctctatttctagaaggttgtcctttatttgttaccatacttgcaagcagtgtgttttctgactgggctccctgtcttgtcgcctttctgacctcgagggctggtctagttccaggatgagttaatcttgttcctctatggattctgccattgatgccattaaagaacaagatttattgctgtcacctccagaagtgatttcatgctgtttgaaacaatcttgtgcaaagtgttgtcaattaaaacaaaaccaaacaaaactgtttcctttttgagtaatctttgaaaatcataatcactttcaggagtacaagatattccaatgtcttctccatagatgtgactaatattcacattctggtggccaagctgcaaatgactgtctttggctcaaatatccagagaatatcgcaaaaccaaaggcctgagaaaagcattataaagagagagagaaaaaaatctctttaacaagggatttctgaagtaatatgtgttcattttagaaaatttggaaaaatacagcaatgcaaaaagagaatcatagatgaccttagaacaactattaactttttgcaccagttgagatataaacatacccacgagtatattagtttaataaatgtctgagtgcctacctagatgctaggagtaaaaagagagtgataaataaatcaaacgtagatctaccacttagggagtttaaagtctatcagagggagtcaagtaacagataaataacgaaatttgtgaaaaattggaaggctggtatttctgacaaaaaatcatttcctctgagtttcacaggatgagaaaaacaggcacgtgaagatcaagggggagagtgcttcagggaaagggaaatgcatgtgaagaatgtatacaggcatgagagaggttttattgcctaaatttaggaagagacaataacggctttttatggtggagtcaaagggagctaagaatgtatacactgttaaaatgtgcaatctaattttaatgtacaagtagtaacagatgaattaaaaattaaaaagatgtactttagaataaaataataggatatatttttattttttatgaaattgcaaacatgtatatactattttaccactttcttttaaagcataagtctagctaggcatggtggcatgtacctgtagtcccagctactcgggaggctgaaggaagaggatccctcgagcctgggagttcaaggatgtggtgtgctgtgagcgcacctgtgaatagtcaccacatgccatccaacctgggcaatatagtgagaatccatatattaaaaaataaaaaaaagttttttgacacatagccaagtctaaacatgtagaaatttacagattggcttaaatatttgtgataactataaaaattccacatctccagctgtctatatgttattcttacacacgtatgtagtactaaaccaaagggatctttttccctgatacaaatgtggagtaaaagtttacatacagcaaagaaggattgattccagcctacaattctactccctagaatttttctatcatgaatgaagcccttccatttttcatcacgataggagtggtttatcagattttcctagagcaattccaattttgcttatcagttaggactaaaatgtgtcatcttcctttctatatttaggaactgtaggaagctgtgctatggcatgtgagatgtgaggagcatctgttagagagaatgccggagctgaaggtgtgagaggtttcaagaaacgataagctttgggctcagcttccccctaggattacaaagggcttgcacatattagagagctaatttttagcatatttccatgaaggcagattttatcttccataaatgcttagattcatagaaatggtgagttggctcaatgctgatccttttatgtctagcttgatgtttacagtaactctggaggtagagggttagtgatttatattttaaccagttccttgtttaacacaatcatcttatcttggctattgcttaacactttttttagggctccaaagaaatacatacatatgtataaaattgttttggatttttgtgtcccagtgttacagaaaatttctagaaatatgcatgaaccagtcagatattctctaagtgagtttaattttatttctttgacttacattttatttctattagtatacctttcagtgttacagaaaggcagatctaccatttgtgttacgttggatttttcaggccattgcatccttttcctgtttattatgttgaggccccctcagttatccactgaactgattaccaaacaacctctcctagagttttggtgttatctctacctgttttttcaaccacgttctcttgaaagaatctttaatttaggctcatatctacaataaaatataataaaataatggctttatttttgttttaattatgacaaggtaatttatgcctgatttgtttatttacttagaactcataatagttattcacatttcagcctgatttaagcattattttttatggttgttttgagatggatcttaaaccatcaaatgttcccagcaaaagatggcatttttttcagaaatatagacattaaacttaatgaaacttactttgccaaattcataccatgcttctatttatttccctatgataaataccttcttacatctcatttgtttcagattatctttctacttcctattacccaagaaaatattgtttttttgcttgttcaggtcaaatgtttaaatcaattgatcaatatttcagtacttgctgttagacaaatacaattactcatttcttctctgccatcactcagagtgttttctccttctggtatactgttcctctcttgtcatgttcttttactttcactgaaacccttcctcagttttaaagtggagctcaaatcacacattcctggtgtcagtttgtccattttctggatttccccagatcttctcatttggaattacactctcccttcagtaatcattcatcatactgtgaacacttatcaccacctgccttgtgttctatgtaggtgaggatgtttttgttttcccactgtggtaacaattactaatggacaaattccctacattttgtaaccctcagggtacttaccttattcataatatgtttccaggaatgttgagtacattaaatgagtaagtttcttagccaaggtattgattccattgaatttactggtcttcaaatatttgtatctgtctactttgtcaagatatgtaagaaaggcaatgaatgacattaatattttccatggaaactaccgactttcagttctatgttacctcctttcagttctgttttacgtctgttttagccttgcgttatcaaatcaattaacttttgaagcctcagtttgatcatctgaaaaaaggaaataatgatatctcctcattgttgtgataattacatagataataattgcaaggagcttgacaccatactgtagcatatagaaagtactcaataaatgccaattaccatcaacagatagtaataactgttactattgtcttcatttttaactttttactcaggatacatcttaggtatccaaggagactgactctggaaaaaacatgaattagaactcagatttcctgatagtatctttatcagaaaaaaggtagagaagtgaatatttctgtccattttatgaaaggacaatcttgatgcacattaatacttcatctcaagccagaatgtaagattcggactggggccatcaaataatcctgcttgagtgattctaccttgtttctaagtagtcattgcctgcagagttttgatgaaacatctaatagagaaattgtggagaggtatcatatgtaattgacagaatacaattggttgtactgaaatatcttccttatgctaaaagaatgaaaacattgatgcatcccagatttgtgggcctttcgttggaagtttgtggagatggaaatttaatgtaaagggaaacatttgtttttcctctgaggaagtctgaaaacttctgcatttcagattttaggttaaatttttcattcacattaacatttctgtcttttagctgatgtatagctcaaaatatctcagatcccctacctcacaccatatacaaatactaatttaaaattaattacaaatcatctaaatataagagccaaaactctgagaagaaaacatgggagaaaaatctttatgacgttggattaggcattctcttgagataagacaaaaaaaaaaagacaagtgacaaaaggaaaagatagattgcactttatcaaaattaaaaaaaatttccttcaaaggctgccattaaagaaataaaagacatcccaaggaggtggagaaaatacttttacatatatatctgatatgggacttataactagaatacataaaatctcttaaaattcaacaataacaagaataataaccaagttaaaacatggcaaaggatttgaatagacacagcttcaaagaagatatactagtagcgagcatgcatatgaaacaatgctcaaaatgattggtcatcaggtaaatgcaaataaaagtcacaatgagataccctgttacaattactaggatggttaaaataaaaaagacagtaataacactttttaaataataagcaaaatgtgcagaaattgaaaccctcatacactgctggtagaattataaaataatgcagccaatttggtagacatcttaacaattcctcaaaatgctaaaatagagttaacatttcacccagtaatgccactactaggtatatacccaagagaaatgaaaacataaatgaacaccaaaacctgtgtatgaatgtttataacagcatgattcatagttgccaaaaagtggaatcaacccagatgttcattaactgataagttagtacacgaaatgtgtttatatccaaatagtggaatgctgttcagcaatgaagaggaatactgatgctacaaaatggataaaccttggaaacattctgctaagtgaaagaaagtagtcacaagggatcacatattatatgatactgtttatatgacatgtccacattaggcaaatccatagagacagaaactagataagtagttgccaggggctgggaggagaggagagtaggcagtgactccaaagaaaacatgggagtaaatgtatgtgggctgatttttgtgaagatgaaaatgttctgaaattgggtggaaactcttggaaagtactaaaaaccattgaatcatatactttatttttaatttttttaaataggcacagaaccaatacatgaattgtatactttgaaggagtgaattttatattatattaataatatctcaataaaactcttgagggatataagaatttatacgcacaaccccccacacccccaacacacaccccagggtaccaaacagaaaaatgagtcagattcaggctccctagtaaaacttatcattataaataagctatcgttggccttatcaaatgtgcttcctgaaaagaatgctgagatatatggaatttgtaagtcagattgtcattctgtcatctttctcatctttctctaaactaaacaaacactggaattaccaccattatgtttgtccacattgtttattaccttccccaacccctaaaagccactacagacttctaatccatcataaaagaatctgacagaagcccaccacgatgacttaagtatatcacagggaagtcacattgcttgtgctaccatgttttatgccccattttgcattctttggatgcgaattttggctcccaccttagctgcaaaatcaggttgcattctgcttagggcttgttttctgtgttagggtttaccaaatattgagagttaatagcttctgagaaccttcaccaaaggggaatggagagccagtaagtaaaggcactcctttactgttctaggtggacaacttggaaggtaattttacactgttccgtccagttgccctgtgggtgtccgtggtggtaaccagtttaataaccctcccttggattacctttctatccctgcttttcccatgcttcctaggcatccctccatatatccttcccccttctgtttcatggtatcccttctaaaactaaacttcttgtatataagcccttaactcagtgtctgtttttaggagatgtcaagctgacacactgtctgatttttagaatatcaaggaccctaggtgaactacttaatgtttctgtgtctcagttgcttcatctatgtggaataataattattattgcctcctgtgcagaaaagagttgacagagtaggcctgataatgctattcttacagaggcctgcttatgagaatgtcccttggctggcatctgggatcgtggctggtacagatataaaattctcccttactgattagagtggatcaccatgcctagactgtacaatgtggtttatgctgcatgcctgcatccttctgggagtttggaattgtggtacatggtagtataagggagggaaaatggcttcccgctttgacacaaggctggttaacagagaaaaaaaccctaattacatatgtaagtgcagccatcccacaaaacggggtcccacaacttgaagaagggtcagatgattgaagcttatgtagcgtcctgagcttacacaaagggataggaatttggggcttcttggggggcaggtaggtgtggagagataagagacaggagggtgaggtgaatacaggatatcttcttatgcagataaatgtctttcaggtaataaaagttgtctggagtagccctcatatagatattttttactaacgtagatttcttttatagatttaagtttcttttacaaaaggacagcttttcagagctactcctgtggctgcagtttcttagaattaccagccaaatgtatgccaaagaaatatattttagggtggcacattctggtcttctacagtcatattttcgggtggtgtgtcctgagcctcaacaataggcagagcatacctatgtgaccagcttctccttcctcacctgctcctctcaaaaaatacccacctgggcactgagttcctaataggcatccctggacggaaatagtccacatgtgttgttgcatttttgttcctgggaaagacgatagtctgtgagaccacctcatgggagagagagagcataaggaagcttgcacatgagttcctccaaattctacctgggtcctttccccttattattcaactgtgtaccattactgcacagttgtcatatatttttgccatgagtacaacttagattctgagtcctgtgagttctagtgaatctctgagtagaggtctggtcttgggaatccttgacacacttgctatggttgttgagaagattaaatgaggtaatatagaagactttagcacaatgcttctaacatcctaaatgtgcagtaaatgttaagatttactaaagtacatcctgtcagctcaatatggggtatcagttggctctgggattcccgagttaatcaggttgactcaatctgtaaaagtcatattagatactcaagagccataaaatgatattagaagtactaaggtttgggtcgggcgcggtggctcacgcctgtaatcccagcattttgggaggccgaggcgggtggatcacgaggtcaggagatgaagactatcctggctaacttggtgaaaccccgtctctactaaaaaatacaaaaattagccggttgcggtggcgggcgcctgtagtcccagctactcgggaggctgaggcaggagaatggcgtgaacccgggaggtagagcttgcaagtgagccgagatcgcaccactgcactccagcctgggcgacagggcgagactctgtacccaccacccccaaaaaaaaagaagtaataaggtttgaatttagcttagtaatgctcagtgcaattgctttaaaacccaggtcctgccaggcgcattggctcacacctgcaatcccagcattttgggaggccgaggcgggtggatcacgaggtcaggagttcaagacaagcctggccaagatggtgaaaccccctctctactaaaaatacaaaaaagtagccgggtgtggtggtgggcgcctgtaatcccagctacttgggaggctgaggcaaagaattgcttaaatccgggtggcagagcttgcagtgagccgagatcgtgctgctgcactccggcctggacaacagagctgagactccatttcaaaaaacaaacaaacaaaaaacaaaaacaaacaaacaaaaacccaggtcctttcccttcatctttggtacagccaatagaaaatgaacaatactatctcacgacttttctattctcgtcagcatgggcctcttccacaagcactccatttaaagtcattgatctaaacttattctttactgtgctgctctttttactgttcacgtctgccttgacaccattccccatttggggtgcccttcctttgccatcagctagctcacatctgaccccactcatcatggactggctcacatcttctgtctaggaagttgtcatgaaggacttgaatcttatgggtctctccttttaggggatagagtgaccctgctgtagttttaaaatcttggatttgagtacaaggatctggattctgcactatagcttttcctctaactttaagaccttgagcaagttacttagattttctgaggccctgttttgtaatccgtaatgccaagataatttgtttaccagggattatttgccaggctacagtgggatgggggaataaatgtgtttaaatactggtaaaagcattgtgtagatataagacatcaaaatacggcacccacgttttgctttttttttacatatataattcttacctccttgctgtatggttttatgttgccattacattcttacttatgttattatgttttatttcttcaggtagattataatatccttgaaggttggacttgcctcgtctacattttgacactccctatcgtagttagcaaagtagtatgctgctatttgggctccgtaagaatcttatcatgtttattgatgaggaattgtgagtttggaaacaatagtttaaggggatttttggaagaggaaaaagcactggattgagcataaccactttacatacagagcaggagctactgaagtggcagattttcagggttactatggggaagtcaaatcttctacactgctggttaacagcaccttaattattagctgctttagaaataagtgccctattgccctgtaatttcatttcattaattatgctcagaggtagtggtatctgaggcaaacaacccttagatttccactgcaccttcatcataggcaaatatttatcatggatagggctattaagttcttcattaagaactttattaagtttattaaaactttctttctcactgagatttaaaaagagccatttagtagtgacctatgaaaatgcaagtattataaagcagtaatatagactatatattattgaataagaattttagcctttttttaacaaatgcagataattattattatgtgccagacattgttacaagaactttaaaaatattaactactttaatttttgtaactctttgcagtagctgtgatcattatttccattttataaatgaagaaattgaggcacagagtgttgtgtaaattatctgatgtcacacagatatgtaagtgactgagctcacaaaagccagtcaattttgctgtatagaatgtgatagaatgtaccctattctatgctgcattctgttactacctgcgtatttatttatttgcagatatgtgcattcattgtgatgttttttaattatttggggaccaatggcatgtcatatcaaaaaaaaggaaagagacctactttgtggatttgcaaacttctattatttatctttacattcctatattttcacttttcattgtaaatacattcaagaagataagttggtagatgataaaatatggatagattaggaatgctaggtaaatagttccaaactctttaatttgatgccaagagagcaagtaatatgaacctcaacagtccatccttaggtgcttttgtcagccagcttcatagtctcatcatagctgactaatagttagtgtcctttttcattttgcacataatccagcattaaaagcataaggtatgaaaggatgaaaagattatgccccactttacttattcgactaaattattatgccttgaccttttgaccaaatcagattcatcttctctctctctgcacttccacccattttaatgctgcggcacagattgaatggattgggagtctgtgggtaagtaataagaacacagagaagagtggccagcatgattaagattttatttgtagtgtaattccattataattaacattatgtaactgtagaaatatggtgtttgcacctcttcctggcagatgcttttaagtcagtggcagagaggagattaaatagtaaatgaagacctatttattgaaaattgtttctacatcctgtattgttggattcatttgtttgtttcacaaaccacagttaatttagtaaggaaaataagcaatatgtttaacaaacactcaaagtaaatttgtttgcagtgctttgaagtaccatagttgaacttttgatattagaagtaaagtattactgaaagatctgcaaattaagggtgtttaaatagtgaaaacaaaatgtttattttttccaaagattactaacagaatttaagtaaatgaaaataatatggttttgcatatggtttaaagcatttctagttacaagtgattttttttcaaaaataaattggccaaataattatgtatttaatttatatacattttgatcagactcctctagccaaggaattggcaatccatagcccactggccagatttgtttctcttcttcttttttgtgttgcccccaacctaaatgtggtttttacatttttagtagtggaaaaaatcaaaataataataatatttcattcacaataaaattatatagcatttaaatttcattgtccataaataaaactttattgggacacagtctcactcatttgtttaagtattggctgtttttacactacaacagtagaggtaagtagctctgagagtctgtatggcctgcaaggctgaaagtatatatcatctggccctttgtgaacaagtttgcagatctctctaccttagcaaataaacaaaacatcatcatcaacagtaatgataagactgtgataagggctttatatacattatttctaatgtatcaaatgatggtattatagacatattattatcttcatttatagatcagaagactgagggtctaatgattaactaatttccttactgagagctgagttttagttggaatatttatagcaacttgtaatatatatgaatgactattagagtttagacttatttaaaaacaacattgtgagtattttgagagtgagattttcttctataacccaattaatatttattaaataggattgggttgattgatttgatggtggttattctagaatatggaaatttggacatctcagttaatttagagctgcaaactaagagaaaatcagtgcttcattttgatgatagatgtcagaaccacttttctgcatccatatggatcttgtttgcttctgctgtatataagaatgattacaaattgctccaacttttattttgaggacgctaatgcattagccttgtagaattggcctatagggactttctctggaattccttgccattcattcatttattgtagaaaaaataagttggctaagatgatggttgttcatactaagagtatattgaaccaggtctgtgaaaggaattgagaagttatcgatgtatttcatcatttatctcattggaccacagtaaatgattattgcattaggatgtggtgataatgggttttgggtattattaaaaaataatttcaaaggaggtccaatatataatatacttagcctagctttaagagtggtagcagagggaaccactgtttccacatcagcttcctgaagtccagtgttaaaagattgattaaatgaaatctgttaggtaaaatgcatttcagttcataaaagtcatgaggcttcttgaataggcccttagaaaaatcaagactctaattatgcagtgctaaacattagaattacagccgaatattcatatagttacgtaagtatttgaaaatatctaatctaagacttccttagatatagctgaaagataatagtctagataatatcttgagggcagagcctctgtcttaaagtatcttcatgtttatatagtaaataaataagagtaagtattattattttaactaatatttactgagaactatgcaccagaaattgtgctaatttttgtaatcaatgcctcatttaattgtcctaaaacctgctgaataagtactaataattattaataatttattccaattttacagggtttacaggcccatatcaaacattcagattagttgagcttaacaatcaagtatctccagctccaaagcttaacaccttttccactatgctgtgttgtgtagcgtactccaaatgtttgatgagtgaatgcatgagaatgtgagggagttatcaggaaaccatcttcatcatggaattttaatctgttcttaacctaaagtttctctactctgaatgctgctactgtggtcatcattattaagctttattagagatccctactctatttacttgttttgaaaagataccatttctgagcaatcccagctgtgacttaagattgaacaaatcagctgtcacctgtcctacacagcagcgcattgacagcacaggtgtggtatttttgctccagtttggatgggttgccaacgatcaggttttccaaatgtgatttgtttagataaaactaaatattaataccacctcaagtgccatagtgtgtacaaccagaagagctctcatatataccttgcgtgattttcccagcaatacggttgttcagatagacaacaagaaacttgcagataagaagagggactcagaaggtttaggtgatttgtccaagtataccagctggaaactcaaactttctgatttcaacaccgtgctgggcattgcctcaatttgagaggggaaaatttggacccacataatgggattgcaccagccttcccatgcccagtgaagataggattgtaccaataatatgggttctttccttttagaaactaacttaatcactggaaccatcaaagcacccacgggtacatacaaaagaacacatgtcatatacctgtgtcatgaataataatgttatgtgtctgcactgtttaatagaaacatgatgtgagggatgggtgcggtggctcacatctgtaatcccagcattttggcaggctgaggcagatggattgcttgagcccaggagttcgagaccagcatgggcaacatagcaaaaaccctgtctttataaaaaaataccaaaattggcttgagcatggtggtgcacgcctctagtcccagttactcaggagactgaggtgacaggatcacttgagcccagggggttgaggctgctatgagccatgatcatgccactgcactccagcctgggcgacaaagcgagactctgtttcaaaaaaacaaaacaaaacaaaagaaatatgatgtgaatcaaaaatataatttaaacttttttggtattcacaccaaaaagtaaaatgaaacaggtgaaatttactttaataaatcattttagttaacacaatatgtcaaaaaatattatcattcaactgtaccaatattaaaacaattaccaattagatactttacactcattttttgctctaaatcttcaattcatactagccacattgcaaatactcaatagtcacatctggctagtggtggttaccaagtaggacagcttggctctgaatagcatgatagtacagttgccatgcttaggcatggagatgctcagagaagaggactgggaggaaatttccctaatccatccccttaactcccccacattttgtcattcagatgatctcctttttgtttaaatgtaaatgtctttttatatttttaacctaactggctattcatctcactgatattcaatcatctgataaagagcttctattctcaagagttctctgaggaagcagtacatctatgcaaggaaatacataaacatgactccagtgattggaacaaaattagaagatttctgaggaaaaattgctgctataatttaagaaatgtaccttagcaacatccaaggctcacgagaatcaaattggttattttgggttaaagtcaaataaaagcactttttcttcacatatttttctttttgtcatttatctaaaacgaatggttgataatgattaaaatgtaattttactatagaatgagaagaaaaagccagaaaatatttgaagtactcttcaatttatttaatcaattatgtcctgataaaaatatgctaattgcaattcagattgcaaggattttggtattttttcttagccttttaggtatttattaacacaatacaacacattcctatgaaattaacatataggattatacctgaattatatatttctataaagaattttccctaaatgacaaagcttaccagagagcatttaaataacatgttttagatatagatatatatagtgcacacatgtacttttcttaaaccttcgtgaatatgactctcttctgagacctgtctgaaattttatatttcctaaaatgacttgatcacatcatcatcgtcatccaataataataataaaaacaatgacctgaaccagaaattgtgcttatttttacagtcaatgcctcatttaaatgtctaaagcctgctaaataattagtataattattaataattgattccaattttacagggtttacagggccatgtaaaacattcagagtagttgaacttaacagtcaagtatctctagctgcaaagcttaagatcttttccactatactgtgttgtatagcatactccaaatgtttgatgagtgaatgcatgagaacaactgttaagatttatcaatgcttattaatactagtacaatgcaagtttttttaatactctttacatgccttatctcattttatctttacagcaaccctattttggtagctattctgaccaataacaggctgtctaaaaactatatagctaaaaattggtatgctgtttttagttttttataaatattgctaaataactccatagagtttgtactaatgaaggcactcaccaaaaatgtatgtgaatgtctattaccccaggcatttatcaacagtgtaacacttttgatctttgccaactcaatagacgaaaacattgagtgaaaatatatttgttttcatttgcattttttaattataattgagatcaagtttttttcttagctcttatcactctctacctctacataatggcttgatcaagggattaacaagctctaaatgagatgactttattatgagtgggaagtcataagaaaggttgagtggaaagaagagacagaggaggtttttgacccaggaagacagattctacttttatgaatagtccctattctcttctctgaaatgaatcgagcacttctgatagaaatctgagtgcatgcaaagaaattggttaatggggcgcctgttaagagcagtcaaactattcaagcatggctagctgctgtggctgctatgattatatttttaaactaatgggggtcagactgaactgtcttgagctatgacagttattaaacatatacccacagaaaccccaaagagaagctaataattgatggccttttatttttacataccagattcttcactgatccctgtctgaaatccactgttgactcttcactcaataaaatcatatgaatattgagtattttaatgtcagtagatggcattctccactggaaacacacttcataactccaccgtatggcctctacataacctcttaagtggtcgatcaagaagcctttgcctgtttttgtttttcgcagtcttgtgatatattctgcattctccgttagggctatatgcattgattagcatatagatggctattctgaactaggccaatactattcagcatgtactacttaatttaggaataatagtatttatgtaaggattatttccagtgaaccaggataggcatagatggtttgagaaatcaaatctgttgagaatcttcagaccgttttcttggtgctaatttcagtgtccaccccctcacccccaattgaaccgtttaacaaagcagccgtataatagaatcatcctagatcatagttattatctgttgcagggacatgaaggtcatctagcttactcctctaattttgtggatgaagaagttcattataataagtaaagacttttctaagaaagtcaatggaaaagtcgggactccctaatttgagcccagtgaattttcctttctcagaattatccatgcccttttaaaatacgaagtgaaatacacagcaaaaggtagaagaaaatcaaacaaaaaaatcacctggaaaatctactttatgcaattagtattggtaatgcttcttcacgattccagcaatgccatataattcctttctctgttaggtatctagtaatttttccttgttttcagctgataatttgtctggtagattctgaaatggcaacctgccatttgacaagaaaaccagtaatggatatgcatttaagaaattttcttgggaggccaaggcgagtggatcacttgaggtcaggagttcgagagtagcctgaccaatatggtgaaaccccgtctctactaaaaacacaaaattagctgggcatggtaacgcacacctgtaatcccagctacttgggaggctgaggcaggagaatcacttgaacccaggaggaggaggttgcagtgagaaaagatcgcaccattgcactccagccggggcaacaagtccatctcaaaaaaaaaaaaaaaaaaaaagaggaagttttcattgcgtctggctaagacttacaaacttcatcagcttgtggagttagtctctgctcatctcatttatatacagagctacttatctgatttgactttattcctgacactggaccaagaaattgttgatggggatttatgctgctgattctattaagaaaattcattaaatgcccttttatgaaactagcaggattgggtacaatacctaacattaggaaaaagtcaaataattttctttagcatgaggcagatgcattgttgattgcctttgtcataaagaaattttatttgaatctttatcagcgactccaaaataagcttgatcattttatgagtgtgatcgtcacaaagagcatatttctcttttacttttttctcttctctttttctcttgtttaagaagtagcaccaatttctttgccagaggaacatgtgattgtattttcagtattttctcactcacaaaagattcaagtttatgctaactggagaccagaaacttgtctttcttgttgcttgaagctttgacaaaatctgtttacttgctttgaacagtattgccctgagtttatttttttggggaaaaaaaggccatacttggaaaaattgagttcttatttatcttggcttatctgttgtatagataacatctgctgtctcagagcttactcagaactaacaaaagaaccaagtggcagagaacacccgtaagtttatacatttcagagacaaaaaggatttatttttgcctgttctatttgtcttttgactacagtttgaaatgagtgattattgtgaatagtttgagatgtaatgatgccaacattatcaatttgtacatttatcaaggttatgcatactaggattatgcatgctatgataacctaaaaactatttaggttaagcagcttattaatatccaagttaactttgatacagttacaaacacagaacctcaaatatctatccaggaaaggaatatcttagcctgtttttcaacatgctacagtaaatatttaatatttaaaaattttgacatttaacacattcagtatctttttattttcctcccctttttctaataattcctataattgtttttataaatttttgaactcttctctctgcttaaaataaaatttctccccaatgcaaattgtgttgtctgttaactgtttagtaagaggagctttgctatcctatatgatgaacacttgattatgtattttgattaatggttactatgccaactagagaactagatttcagtaaaatgatcccactagattgtaaattttgttaatttagaagtaacaagagcatctagtattatgcttattcttgggctaattcatttctttactatcatttattttatattaactcatttatttattgttacaatacatccacttaacacccaggttttcaatggccactctgaaagaggcattgttctaagtgctggaatacaaatacgaggcattatcttgcttcagtacacatacaatgtagttgaaggaaagatttcagtaaactagtcaaaaaatttagtgcaagtagaaatgttattataggagatacagcagtgggccatcttaattcaatggagaagggttcaggaaattgaggttggtcaagttgagttttgagggatgttaagtaagtgcttctttagatataaggtactataagttgtacacattattatgaaagcactgtgtagcagcaacataatcataatcattatgaagttacaggatagtctcattgggagcagttgttaagtttacatcctctaggtcattgctaaaactcggtaatttggcaggaagtacgtaggagctgaagataggagaatccactctgctgattagcaatgaaaccacaggccacccactgaacctctcttactttacttccttatctgtgaactgggataataccattaggtgctcatttaatgtcatttaatgcttgatataaagtctaaatgacgtcatgtgtgtggaagcatattgtaaattgaaaagccctataaagtgaaactgactttattctatacatatttattcacacctgctgtgttcaattcattgaactacatgtgaagagtaaatagttttgttttgttttagtcttcaggaagcagtgagcatttttaaaaggtcgttattgaacccagtactttttgtttggaggctcaggaataatgttaattatttcccttgggaatgcaacacaagccatgtctgtgtccaaatgggacattaaaaaagcatgtcctcaaactatcatttttatttattcactttaatttcactcactaatacctattggatgtcaggctctgcactagacatcaggatgccactctcatttggtgggcagttaaggctgcagtcacaaatcacacatcataaaagagagggagatagcaagggagatcacatatcaagtagggagatagaatgagtaggcagaagacggttaagagagatcgtgccagaagaaagggtatgaaatgggaaggaacatggcacattttaagaactgaaacttcttcagtgtagctggactgcagagagcaagatggaggatggtagaagatgagatggtgggaatatttggcaaagaccagacagtgcagggatttgtaggccaattgaagaattttggccttttctctatgagtaatgggaagacagtgaagcatcttaagagggttgaggtaagagggacgatcatactagctactaaagtttgtggagtcagtagtggtaggttgtggggaggtggtggtgaagatgaagagatgtgaatgaagtaaaatggtcttgacttagtggtggattggctatataggagggatgagagggaggcagaatatcacattgaatttaaatttagaaaggtttactgtaagctgggtgtggttactcctgtttgtagtcccagaaactccagaggctgaagcagtaggatcgcttgaggccaagagttgaagctgcagtgagctataacccaccactgcactccagactcagcgacagagcaagacactgtctcaaaaacaaaaacaaaaggaaaagcgaaaagggagaaaggtttagtgtaaaatctttgagagtaaaaagagagagggatttctaaatcttggattgtgcttatgccatttaaaagctttataattgttgtgcaccttctctaacttatttaatataaccttcttgaaggttagatttcaggttttaaaaaatattttatttctggtctaaaaatttggcagggattttaaagaaatggtaagtgataagaagggagttgttttcatttagtttgtaaggaatgaatattggtatttttatgatctgatgaaatttatcctttaatttcaagtgagacagtttgactttcatatgaagattaaataattaattttgcttacttcagatattcagatttaaattagcctataggccattattaaaatagatttactgtgataattttcttgctcatcagggtaacttattaaacagattataaaatatcataataaaatcaggtcctctgtaaatccagtgaagaacgttttttaacatgacttgccattgagacgtttttataaaaccagtgatacccctggaaagtaattgactaaagaaaaaaaaaagtccaggtttattcctcattgtaaaattcactttttaaatttgcaggctatgaacaattgaatttgaggaataacgtattttgggatatgtaccattttatttaaataagtaaataattatatggtgaaggaataataaatatgtattatcttctaggaattgtataacagttttgattactgattttgacgggactacttttccttatgaattatggaatatatagctaaatcttatataaacaatatataatgcaacagcaatatattttctattaaactataaaatagtaggttaattttaacatcagatttagtccaaaatttatttgccaataaaatgaataatagaaaatttttaatcataaaatttcatttgctgatgtataataaaattgtagatttttcaaaataaaaaaatcttagaaaatatcttaaatttgttatctgaattgctaaatacaatcttcaatgtatttaatgctttcccttcagctatttatttggctttaaatatttggtgatttttaataaaatgtatgtattttgctatgttaaaaatccgaatgttgccaaactgtgcgttttggaacctaacttactcctgtaaaaatgattttatgtgttgtcatttttaattatcagttggctctgtgttttttttttgagacggagtctggccctgtcgcccaggctggagtgcggtggcgccatctcggctcactgcaagctccgcctcccgggttcccgccattctcccgcctcagcctcccgagtagctgggactacaggcgccgccaccacgcctggctaatttttgtatttttagtagagacggggtttcaccgtgttagccaggatggtctcgatctcctgacctcgtgatccgcccgcctcggcctcccaaagtgctgggatgacaggcgtgagccaccgtgcccggcctggctctgtttttattagaaaaattctcaatcgtcgtcttttaagtgagtcaacctaataccttttaattttgtgcaaagttctctgttttaataacttttaatttagtgcatatatcatatactggagaattatcaatttatttgattcttttagcaatttatattttggtaattctgtgttaataatgtgatttgtatttggttacgcagttgccgataatcctgtggcattacagagtttgatttatgcggacgatccttggacttaaaaaggattactgaccatttaagaaagattaattaatgagtataacattgagtcctaactctgctaatgcttgtctaagctacacacagatacatgcacagacacacataccctcaaatctcataccaaaaatgaccaaattacaacaaaggggatagtatcctatcctgctaggccatcacattatggatcagcagtgtagagcaagtcttgtggggcctgatcttgctcttacaagctttgggatcttgggcaattcagtttccctaagctcagttccttatttatagtcagtgagatgaatcctatggtctcttaggttccttttatttcgtaattcaaaaagttgaagttagaggttaataattttgtattggtaagactgcaatagcagtcttcttcttataattaataaattaagaagttacagggaccaagggagaaaggtaaattcatttatagggataagacaataaaagggtacaattaatttatttggtcaccagtgttcttgttttcttgctgaattttatgggatgggaacagatctaggaaggaaggctcgtctgtacccttttgccctacctgacgtaaaactcaggactgacccatcctaaaatcattcatttagaaagaatccctcataaccatgttagctcaaggttatcttgtatctgatttctctcttcctgcataggttgcagactgaagagcattaaaatatctgttttcttagtggttttcctttctggatttgaataattcacttgattcttccaggctacttaaatgaaagagtgttatctaagaatgctaatcttagttccttttgtttgagattagagaaatcaatgcattatatttttagtctagatagtaagtcctgaatgccctttactctggccatttaaaaaactaaattattttcagttggctttcatattgtggggttagatattcatttgagatatgttttcttttttccttttccgttcctttagttaaaacgaaatcttaccctaaagtgggataataaggggaaagatccattgaatttgagtattgggcttagtttgcattaaatgctccttttgttcctgtttatgtattattttaagctcgtttttccaaatataccaacagcagatatcaaatgaccattacttcatactagaaggaatttttataaaccaggccaaagacttcactagatttctcaaactttgtttctaactctgaaatcctatgattttatgatttttaatatattagagtaaacctacaaaattgtaattttgtaggtgaacaatagttagacagtgtcggtttcatatgattcaacctacatatggaagcttagtcattgcattgtttaggaaaactatgtaactcatgtatgaaaatggtaatgtcaagcaacgaagcttattaagacactaacatcatttttaaaatttagttttgaatactagatattaaaaattatattttaaacgtttgtaaatccagtgagaataaaatgttctttgcatatcttatttcttttcacagggagttttttcctgtgttttatgagaaaaatcacaggcattacagtttgaaatcaatttcattgttttcattgcaattgctacatagctgttgaatatttgtagtaaggtttaatgactaatgaagtgcatgcttgattatatgccattagtaaaaatatatttttatggcaaagggcggtttgcagcatggcattgacaaaagcaatatgtaaatgtgttactccccttcaaaagaatgcaaatcagtataaacaaattttaaggaaaatatttaaaaataaacaattaaaataatggatatttattgtttgttacttattgagatgatatgaatatgtaaatagagcacttaggtctacttattttcagaggccagtgtactactaattagaaaagttgtagatatcataattactgtagtaaattaatttgtctttattgcttacattttattgcttggtattccaggcattggatagatagttacaatgctgacatcaagagtgttcccacgattatttctccgcttttctaatcatcaactcattatatgtcccttatcctcctgctacttattatcacttgccatttcactcattatttgctcctatctctctgtctttgctcattcaattctcttttctagggataccccttccttccagttcttacctgccaaagctgtgtttggcttctaatgtttagcttaatgtctgcatcttctgcaatgtctttcagatgtctgcagtcagaactctttactcaaggtcactaccgtcagcttgtctttccactggagctcatccagaacacattgctttgtgaccaaacacattctctctgtatctgcctcccaattagactgtgtacttctcttccccatgttccctcctttgacacaagtcatgctcttctaagcaatccaggcttgttcagttgaattattttctaaaattaaaacggtatgccagacaaggtaatacaagtctaggcttgatttttcctgagtgttgtgtttgcggtgggtgggccaattatttctgttccttttcaaaggatctcacttatcttcttgttttctgccccattggataaatcatctcatgtcatcatttatttaacttcaaacacaatttctaaatgttgaggaatacgagaacaaaaagagcatgtctgcatctgcatacatggtcttaggtattgggtgaaagaccatcaaaaacttatattagtactaggaagaacacaattattttaaaatacattaaatgcataataacttttaaaattaagggtcaggaagaaatctctaatagaaatcacaaaacgatagacattttctttgaccattcttgctttgcttctctaatgtatatttaatattaatataaataacagcagtaatgacaaccataatggccactaccatgtcatagaatgtactatatgcattcacgtgtttcatctgatttggtccacatatcataacatgaagttggtgaggctgaggctatatatgttattcagactcaagatagaaaggattcattaggaaagggttcatgagaaaaataagcttaaagcacaatgttttcttccaactttccatttcaggggtacatatgcaggatgtgcaggtttgttacataggtaaatgtgaagcagagacacttttttaacatcagttctccagtgagttcatagcagattacagggtcaaaatatatatgcatacaccatagtaagcaccatttaaacttgtagaagtaagaaaattgtccttgaatagtcagttcaatcttcctgtgctctattgagtgtatctatctgtggatacaaaatgaataaagatggatctggacatttcacccttccgcatatgggagtaaaacctataaggagactaataatatcatgcatcacaaattacttgctgcagttaaagaagttttattcagatcctcatgatctcacagggatccagtatcttgagagttgacgaactttccataaaaacactaatcacgtataacagttcagtcaaaatctactgatatagatattccaaagtatggcaggaatttagaacaaaagatggaaaatttgaaggctctgatctgtaacatttcttcttaaaatatttcagctgacttgcttagcctggtatgcagaatctggtgcaagctgagcacggtctaagttgcctcatcatctcagctctccatgcttctgtatttgtatacttccatacttagcaagtaactgttctccctccatggaatgtattattatcctctgccactgtcctcttaaacctggcaaatgcataactttcttttgagacctacctttgttaagacctagctctttgaagacttccctgattgtccaaggtaatgttgactttactttgtaactgtatgtatttttcttatgtcagcaaccactgctctgggttattactatatttttctctcccaaataagacaagaggttctgttagaagtggaaccttaatatccatttttatgtgatgaatttctaggcccatgtgtgggctgtattaaaggattaaagcaagcttgttcaacctgtggcccaggacagcttttattgtggcctgagacaaattcgtaaactttcttaaaacattatgagattgttttgtgatttttttttagctcaccagctatcattagtgtattttatgtatggcccaagacaactcttcttcccatgtggcccagggaagccaaaagactggacacccttgggtgaaagcttattagtaatgagtaaataaacaaaatggagtggatgaatagtgtagttcactatggacaagttaaataatgcttttctcaatgataagggcaaaatgaaaattctgagatttctacatgcattatccttgaaacctttagtattttacatgtagagaggtcattgttcagactcgcatttgatagagtaatcagtgttgaagacattcccaatggtgtaagttgccatacttctgcagtataggctggttgcccacaggaaaatattggagacaaagctgaaagcaatgtaaaaaccttgtgaaaaagcagaatgtatctttgaagaactgcacttaatatgttattcagcctaatttgtgcattttaagtaacatgttgatgagttgtacggtagttttcctttatccatagcccataccacaactccaagtagatgcctgcagatggtactgaacccttatatatactatgtttttcctgtgcatacatacctatgataaagtttaatttataaattaggcacagtaagaaattaataactattgataaaatagaacagttataacatcatactgtaataaaaaaaatctatgtaaatgtggtttctctctctgtgtgtctctctgtcatctcaaaatatcttattatactgtactcacctatttttggactgtgggtgaccacaggtaactgaagctgtggaaagcaaaaccatgaataagtggggactgctgtatgtgttgtagagctgtgctgtccagtctgtcagccactacttacatgtggctactgggaaatggaaatgtgtgcccaaagtgatatgtgctgtaagtgaaaaatgaacattaggtttcagaagataagtacaaaaaaaggaatatgaactatttcactattgtttctctgttgaaatgatattttgagtatattaggttacataaaatatattattaaacttaattttatccctatctctttactttttaactgttactgctagaaaatttcaaactgcatatgtgtcttgcattatatttccattggacagtcctggaaaggaaattatgattatccagagaataaagtcattaaataaaaggaaaggttaaataaagtatgacccgtcaggagagagacaaacaaggagagggaacagggtaagtcagccaagcatggaaacatgtggcgattgctcaagggcttgtgctctgaatctgaaaatgctgtaatggtctatgaaaatacttttagagctagtaaatgaaaataagtgcttatataacatataaacttaaaaaattcatgatatttaatgttcaataactatgagaaggcttaatcaacctactgtaatattttaattaaaaatcattctaacgtcaaataaacggagaaatactgtccgtcttccataatagatacaatggatggtttaatgttaaataccctgagaagtcttacagctaaaaatttatcactgtttcaaacagaattgttcccatatctggatgatagaactcactcctcctatgtatttaataatcagtattctatgagatatattttgggagatacttagtagaagataaagtcactgtattttattagggatgaaactgaggctagggagatccctaattcatttgagatctaatatgtgggcaaaatagacagattggtgcaatatccagcacagtttaacaaacactttccgagtagctactttgtgccagttattcattctggcaataagacgaataatacagccaggttggtgaatatcacaattcatagattctcaggtgattgttctcatgttttcagaaaaaggcaatgacagtgtgtacactgacccagagggtgattgtcctgctatacttaattttccaataactcctattgcattgaaactgttgcaactattcttcagaagtatagacattgaaataagtaaaataaaatagtaacgtacattgagttttagaaatgtaccatgtacatgtttttagaactcttagcattttgatttaaaataataaaaattggtgtacgtattttcttttgtagacaaaagattgtagggtgaaaatttgtaaatttaacctaatattttattctcattggtcacatgttatgaaaaattatatacctttcagctacctgtaactatgtcttctatgagtaatcatgaactgtctagctctgctgaagtttttatatttttcatgaattcgtacttaaatcctagcactagagttccttttttgagaattattccttttctctcagctcttctttcaactttaccagcaacaggcacacagagagatacatctgtgtgcacacatgcgtgctctaccttacactctcacattctcacactgtcagatgctcttagataaatacctttctggatgttagtttttcagaatgtcagtggtcccaattattttcctcaggtacagattaaaattttaaccctacattctctgataggtttctgtttaatagcactgatgtgtttttttaaaaaaaatatcatacaatgcaattgcatattttggacattctcatcctgcaactactttccctccccaaaatgtttagattctgtggctgagatacagtaaagtgcacaaaatcatgcaatcatttacttattcattcagcaaattgtcatcaaggcaatgggctagcaattgtggggataataaggaaagcatttttaataccccttatcctgaaaggaaacctttaatgggaagatatttttgctatcatattacatttttttgagtaataaaattgctgtgtttaacatttgccttaagtaacttccatagatagttactttcatgctggcccatagctgtgctggggatagtggtaggcacatctttaactcgggaattagtttgaagttgcagaattgttagtaaatgtagtatttgttgatttattacacatattggcagcaatgcaatgtgtatatactattataggaaataccaagaaaaataaaaattaaaagacaaacagcttataataattacccacaaagggctttttaccatgaaaaggagagaggggatggtgggttcaaacaaattgttctaatagaagatgagttcctaaaagaggcatagatgaagtttgatggggcattcagaggtggggaaaagtcctctcagggggattcagggaatgttcgtggaatgagttggcagtggatttgttcagtgtaatgtggctgcgatttggacatacagacttggtggagatgttcactgcaagttgagtaagtagtgcaaacatacacatagagacaagaaaagtcttagggcgtggatgtgaacagcaactggaggaggttggttaagtacaagcatagaatgggaaatgaatgtgaatgccatgcacaaagcacatatgcattgtgttctactatatatttacacaggtgccttttctttctctggaagggagatttgcatggatgcctttctaggtggatgtcatacccagcgaattctgttgataagctattgccgttgcagtgactgcaataattcttgagcatgccatctttaccagctctgctagagtgttgaatgttcaaaagaaaaacccaagtacctattaaatcatcagatgccatagtgtgtttataaaatcagatgaaagccaatttctgtattagagcagatctacttttctgtgcttggttggtgttgtaaggagagattattctgcttccctaagaaggttaagctgtcatctagttaaatatggacttaaaataatgctgccaaagcagttgcctcttgtgattgatgatgatgatgacagatgatgatagttttgaaatcagttttacagggaaaattgctatttttctactttggctgatgttgtagttctagatttgcgaatttcttgtcatattcgggaacatttttgattaaaaggaaaattgctaaggactgtattcttgatgataaaatggctctaaaactgagctatggggcaaatgattataagttgacttatacatattatttgagcgacagcagttattcttggctttacagtgtcattatgagttatattttggggaacaaatagcaacccatgtctagtcagcaaaagtggcagaaagtgtggtacttagaagttatgataataatagtgtcttactaaagtcatcaaagaactttcgtatgtattactattaaattttctctacaattctctcaggacttcatgcatgtgtttcctctccttgaattgtttttcccctcagatacctacatggcttgttttctttctctagaagaatagccgcaccctctctgcagtctctcattcctccatggcatttatcaccacctgacatgtgatatatgtatttgtttactatctcctcatgctaggttgtaagccgtgtgaatgctgagactggtttcttcagtgcaataaagtaagaacctataaaagttcctggctcataataggtactcagttagtaattcttgaatcattagctctatgaataaatctttattttatacatagacgactgaatattgtggtcatgatataaaaagaagctaatgtttggtgccagaatcaaattcaagcttttcagtttatttaaccaaattgctttggtttgtgtctatgtaagtaacatagacaacaaatagccctgaaaaaaaggagtaatagtgaagacttactcttaggtgtgaaccatttctgtacctcatcacattctagaatcaatcaatcaattttgtttatacagaattgctggtaatggctactctataccactgcattgtgtgagcctgtgcagacactggtctgaaaaagccattttcaggaaggaaaagaaaacagaacataaaccccccaaatattttttaaaggccaataacatttgtatccattgggtaaacacgatcaatcaaagctctacaagccttctatgggttgcttccttaacaaatatgttttttgccttggccattcatcatatctggaagtttgggtgatgagcttgagcactctcttccgttaatactgaaaatagccacttagtggctttgtgaaaagaaaagcctgttaaagcgacagaacaaacatgcattctcctgacgatataaaacaggatattgtagattgtttatattcgtgtgggcttggtgtaatgaaattcagctgaattttaagaagaggatttgttttaatgggaaattaggttgtgaatggaaaaggctacaatgcagatacgaaaggtattccctcgtaccctccaaacgcataaggagttttctaatgagactgagagtagtagctgctaaaagcaaagtcatcttatctgttgtctgagatgaattaccttaaaaaattgtaccctgacctcattactatacattacatatattgaaacatcactatgtatctcctgatatgcataattattatttgtcaattaaagaaaataaaataaattataaaaaaacattgtagatgggcttaaaaagtgaagaaataggtagcttctgtcaccagcactatttagagggattgatgaactattttgagaaggttggggctgggagaggagtactatgaaaaatgaaaagtcacatctctggaagcaggcatgtagtatcacatccaaaggacactgtacatacaaggtctactgcagtcagagagattaaaataatcttccgacctctgaaataggataatacaccaattataagtgatctcatgactagaaagtgtactttttttccaggacagttagtgtgtctgaaagtgagcagctagaaagttcaaggaggcagactcacttatttttggttatagaatgggtagggtttgggccaaataatctagcttgtagagtcaagtttagtcatttgttgaggtttacaggaagcacaaagagagaagagtagttgaaacagcataggttgggcaaagaattaaatggtgggataaaatgggtcttggtaaaacatgtaaatgagattaaatgagctggaaagaaatcaaccaaacaaatttcaaatgctgaaggtaatagagtgggtaatggttgtcccattatgtggtggctttagttttcagtcctagtaccacaatgccccttgccatagaccttttctttaaaacaaacaaggaatattcttatgccttattttctacataatgagtgtttttattgattttagatttttttcaagatccctatagagggattttgaatacttttcatttcctgctttaaccaggatgtctgccagaaatggatgtaaagcagtgcatggattttaaaataagaaagctcttagaatttccttatccatttccagtgctttgtgcattgctccaaaatattgctgttttcagtatgggttttgggtctcatatagagaagatggctcatttgatcgaataacatttcatataattgccctttataatttaacttttctatgtaaaatcatattcacttctgtgtgatcaattacaaatataaagatttaatttcatgagaattactgctccttcaattaatagactagagaagaagagattctacattttcccttaaatggcataactaattaatagcgaaatgtgactagaacccagattttctgaatcatggactcagtgttgtttctcctacgaagagcagatagagtacttgtagttaaacaaaattagattaaaatttcagctatcaaccctattagcaagttatttatgctgtaagcctcttattttttaatctataaaatgaagttaataatagcatttctatagcattgtaggatgactgtagttgataatatatagctagagggaggatattgaatattcccaacacaatgaaatgataaatgttcaggacgatgcatatgataattaccctgatctgatcacattacatgtatggaaacatcactatgtgggaaataaccaaactgttttggaacccttgctcatgaaggaatttgcattttgtcacactatttgcatgttcatttggttttggactgcattatgcatatttaaaacatactaaatgttatccctcaaagaatgtgtaatcttaacagtcctgagtgaagacaaaagtagacagtgatcgtggaatccagaacatactatccaatgatcaatataatacctagtaatttaaaatagagccttttactgattttgctctagttctagttaatgaagaaaagaagagatcattttaaaggaataattagtaaagacacctgcaaattttatgcataagtctgagtaagagaaattctgctgataatgctaatattatattgtcacctatatatatagtgtcatatctaaatattttaaaaataccaaataagaatatcctgctttttactatagaaaagaagctaatggaaaaccgatcatctgaccaattattaaaatgcatcctctctcctataagctctgttgttaatttcgtgatacaccttgaatatgccacaagcaattggtaatagcatcaattaacatttgggaagttcagcatggccacctaagatattaaatatttgctacaggaatgctaatgaaatccactgatgttatattcccaaggtattgtttaccaataacagcaaagctaagggttaccaaataaatgaaggaagatctacttagagctgttttcttcaattattctaatttttgtgttctcattttggttctgagttttctcacctgcatttgaggtcagagtctggaaacagggctttcagggatgcatcactaatgtcctttaggaaatatgtctttgcataatcaacgtcattgaggagacttttataagaaaatgaaaaaaagaatgaatttgactttcccttcactttttttttgtagagccattgccgtttctgtatttggataggagagaaatgaagcattgttatttaatttagcccttattataacatattatgtagtctcttagggtggcatgttaccaaaaacaagatgttctattttaaaagttgatttagtattacttcttttttttaattcacaatacattatgtaggtaggtttttttttctgtacattacacaccacagactgtattagaaaataatgttggtgtagttttattgaagccacatcatgaaacataagtattataaagagaaggctgttttcccatttcaatcagttgtctagttgatgtgtttatttttcatccaatttattttatatactaaaaaacagctcttaggaaagtgagtacatcaaactcagtttcattgatttaattttatttattttactttaggctaagttaattcaaatcaatagcgtgtatgtatttcagtgtaacctgtgatgatttctgctcaaactctacattcacatttataggaatcaggatattgccagatacgcactgatttaatgaatgaagacattgcagatattagaaacaacagtctctaatgaaataattgaatttatttttccctccaacatagttgagtggtgaaactatactcttgataaagttttttattataatgtattaagtacagtggtaaataaaatggacttcattttcaaatggatcttcagcaaaacattaggtttttaaatcacctttattacatttttatgtatctctttttgggatcttattgctttattagtatataacgtttttgatatttctaaacatgtttccaaaaatctgaatttacacattgataaaaataaaaacgacttagtcttctctgtcactgtgttctttttgcacttccattgactatgttccattcatgaataagaaaaagaaaaaaattagaagagatttattggaaagcaaaggtaactcttactactatttcatagaccatctctttgattttgcaggttagtttgtcctgtctgggggagataaaatgtagatttaatatggctaatgatttagaatcctgtctactatgaaacttaactcacacactaagaaaggtgatataaatgctgaatccctttaagtacatcttggcttgatgatgatatttgatgatccactgatttgtcttccaaaacactgtaacatttggttctttctgaaatcatcaatattattgttgtcgaaagacttcagaaagccagattgtctcccaaattgtttaatacttctttgctttttggtacgttttcttatttagttattaaataagttcttagtctttaaagctgatttttaatttttttgtcttttagggactactatattcacaaaagaataccagtaatacatgcacagcacaatgaaaaaaaccaatatgaagtagttgtttgattagtttcagcaatataaatggccactgcaagtagtttaggagccaaagagcattcctgcaatctagaattagtagtttcatttttttttcaattgaattgaaattggtcaaggtaactagataatgctaaatccccagtctactttgtgccgtgtagttattctaatcgtattgaagaacgttgtccatttgtcagcattttacaaagtgtgttaatgacttctattcctgctaccttatttttctgcccattagaataaacagtgactttatgtcacataaaagtagccttatagcctttttaaacgtttatttttgacaggagttgatggtatggtatttatgagagctgagaccagaattaaaaagttgtaacacattgttttagtgaacgaaacaaaagaacaaatattctgccacacgatttataccataattctagaatttactttatccttttataaattcaacagctaaaaaggtctactgactaatttttcttaattaaattattttcttgaaacagaatataagttcctgctactactactactaatctcatctttattggaatcagttaggtcatattgagccatgattactttttcatttttttttttttattgagacagagtcgcactctgtcacccaggctggagggcagtggtgccatctcggctcactgcagccttaacctcctggactcgatctatcctcccgcctcagcctttgaaattgctggtattactggcatgagccaccacacctggtcaagatttcttattaatttaacattttcaactatttctgcatagttgatatgtgtcctattgctttctgatttttttttaatttgttctttttggttattatactttaagttctgggatacatgtgcagaacatgcaggtttgttacataggtatacacgtgccatgttggcgtgctgcagccatcaacccataatctacattgggtatttctcctaatgctatccctcccctagccccccacccccctacaggccccagtatgtgatgttcccctccctgtgtccatgtgttcttatagttcaactcccacttatgagtgagaacatgcggtgttgggttttctgttcctgttttagtttgctgagaatgatggtttccagcttcatccatgtccctgcaaaggacatgaactcatccttttttaatggctgcatagtattccatggtgtatatgtgccacatattctttatccagtctgtcattgatgggcatacgggttggttccaagtctttgttattgtgaacagtgctgcagtaaacatacatgcgcatgtgtcattatagtagaataatgtataatcctttgggtatatacccagtaatgggattattgggtcaaatggtatttctggttatagatccttgaggaattgccacactgtcttccacagtggttgaactaatttacactcccactaacagtgtaaaagcattcctatttctccacatcctctccggcatttgttgtttcctgactttttaatgatctccaatctaactggcgtgagatggtatctcattgtggttttgatttgcattctctaatgaccagggatgatgagcgttttttcatatgtttcttggctgcataaatgtcttcttttgagaagtgtctgttcatatcatttgcccactttttgatggggttgtttttttcttgtaaatttctttaaattccttgtatattctggatattagccctttgtcagatggtggattacaaaaattttctctcattctataggttgccttttcactctgatgatagtttcttttgctgtgaggaagctctttagtttaattagatcccatttgtccatcttggcttttgttgccgttggttttggtgttttagtcatgaagtctttgcccatgcctatgtcctaaatggtattgcctaggctttcttctgtggtttttatagttttaggtcttaggtttaagtgtttaatccagcttgagttaatttttgtataaggtgtaaggaagggctccagtttcagttttctgcttacggctagccagttttcccaacaccatttattaagtagggaatcctttctccattgcttgtttttgtcaggttagtcaaagttcagctgggtgtagatgtgtggcattatttctgagggctctgtcctgttccattggtctatatatctgttttggtaccagtaccgtgctggatttataaagcaagttcttggagacctacaaagagacttagactcttacacagtaatagtgtgagactttaacaccccactgtcaatattagacagatcaatgagacagaaaattaacaaggatatttaggacttgaactcagctctgaaccatgtggatctaatagacatccacagaactctccaccccaaatccacagaatatacatttttctcagcaccacatcgcacttaattattggaagtaaactctaataattggaagtaaaactctactcagcaaatgcaaaagaacagaaatatgacaaacagtctctcagaccacagtgcaatcaaattagaactcaggattaagaaactcactcaaaaccgcacaactacatggaaactgaacaacctgctgctgaatgactactgggtaaataacgaaattaaggcagaaataaataagttctttgaaaccaaggggaacaaagacacttatgtaccagaatttctgggacgcatttaaagcaatgtttagagggaaatctatagcactaagtgcctgcaagagaaaacaggaaagatctaaaattgacagtctaacatcacagttaaaagaaccagagaagcaaaagcaaacaaattcaaaagctagcagaatacaagaaacaactaagatcagagcagaactgaaggagatagagacatgaaaaacccttaaaaaaaatcaatgaatccaggagctggttttttgaaaagattagcaaaatagatagactgctagccagactaataaagaagaaaagagagaagaatcaactagacagaataaaaaatgataaaggggatatcaccactgatcccatagaaatgcatactaccatcagagaatcctataaacacctctatgcaaataaacgagaaaatctggaagaaatgtataaattcctggacacatacaccctcccaagactaaaccaggaagaagtcaaatctctgaatagaccaataacaagttctgaaattgaggcactaattaatagtctaccaaccaaaaaaagtccaggaccagatggatttacagccgaattctaccagaggtacaaagaggaactggtatcattccttctgaaactattccaaacaatagaaaaagagggaatcctccctaactcattttgtgaggtcagcatcatcctgataccaaaacctggcagagacacaacaaaaaaagaaaatttcaggtcagtatccctgatgagcatcgttgcaaaaatcatcagtaaaatactggcaaaccgaatccagcagcacatcaaaaatcttatccaccatgatcaagtcatcttcatcactgggatgcaaggctggttcaacatacacaaaccaataggcagagagccaaatcatgagtgaactcccattcacaattgctatgaagagaataaaatacctaggaatacaacttaaaagggatgtgaaggacctcttcaaggagaactacaaaccactgctcaaggaaataacagaggacacaaacaaatggaaaagcattctatgctcatggataggaagaatcaatatcatgaaaatggccataaggtaaaagtaatttacagattcaatgctatccccatcaagccaccattgactttcttcacataaacagaaaaaactgctttaaattttgtatggaaccaaaaaagagcctgtatagccaagacaatcataagcaaaaagaacaaggctggaggcatcaggctacctgacttcaaactatacgacaaggctacagtaaccaaaaaagcatggtattggtaccagaacagatacatagaccaatggaatagaacagaggcctcagaaataatgcctcacatctacacccatctgatctttgactaacctgagaaagacaagcaatggggaaaaaattccttgtttaataaatggtgttgggaaaactggctagccataggcagaaaactgaaactggaacccttccttacaccttatacaaaaattaactcaagctggattaaacacttaaacctaagacctaaaaccataaaaaccacagaagaaaacctaggcaataccatctaggacataggcatgggcaaagacttcatgactaagacaccaaaagcaaaggcaacaaaagccaagactgacaaatgggatctaattaacctaaagagcttcctcacagcaaaagaaactatcatcagagtgaacaggcaacacagtataagagaaaatttttgcaatctatccatctgaaaaagggctaatacccagaatctacaaagaacttaaagaaatttacaagaaaaaagcaaccccatcaaaaagtgggcaaatgatatgaacagacacttctcaaaagaagacatttatgcagccaagaaacatgaaaaaacacttatcatcactggtcattagagaaacgcaaatcaaaaccacaatgagataccatctctcatcagttagaatggtgatcattaaaaagttaggaaataggccgtgcatggtggctcatgcctgtaatcttagcaccttgggaggccgaggtgggccgatcacgaggtcaggagttggatatcacctggggcctacatggtcaaaccctgtctctactaaaaatacaaaaattagccaggcgtggtggtgcacgtctgtaatcccagctacacaagaggctgaggcaggagaatcacttcaacccgggaggtggaagttgcagtgagctgagatcgcaccattgcactccagcctgggcaatagaatgagactccatctcaaaatcaatcaatcaatcaatcaggaaacaacagatgctggagaggatgtggagaaataggaacgcttttacactgttggtgggagtgtaaattagttcaactattgcggaagacagtgtggcaattcctcaaggatctagaaccagaaacaccatttaacccagcaatcccattactggctatatacccaaagcattataaatcattctactgtaaagacacatgcacatgtatgtttattgcagcactgtttgcaatagcaaaaacttggaaccaacccaaatgcccatcagtgatagactgggctttctgatcttttgattttgaggtttcattgaatattagcacagattttcttatttttttttctgtctcaatatacatttaggaaattacttcctaataagtaagaagtacatctagatagttgttggatgaaatatattaacattagctattgcttaagaaaacaactggataatgttttcctacctttttaatcatctcatcctgctagtgtactgtgtttgctcatgtttatgaacctaccacacataatataattggctctgaacttcctgaattgcaaatcctgtattcaataatttcatgcatgcagcctatttctcaatttatttctgggaactctaatcttttgcttcacagatactttgaactggcatctcatgtcttagtctgagttcctaacctttttatatttttttattatttgtattatttatatattgatttcttatttctctcccattgaaatgtaagatttatgagggcagaaaacttttccatcttgtccaccagtgtttctcaggcacttagagaactgtgtggcctaagagggattgattgtgtactcttacattattctttttcatttattatttcatttgtttcttataaccttataaggcataagtgctattctgtaggtgaggagacgaagacatacagaggttaaataatgtacccaaagctatattgctctagtagttggttatttagtgatttttttttttggctctgtaaatttgaggccatttttcttcagaacattcccttttccccagcatctttatggtacctggctatgcacttgcttttgctcataagcctaggttttgtctggtcagtcagtgaacataaataaggaatctgctaaccaatcaacaaggaggaagggagaaatcagtgaaaatcgtcactaatgttgaagataataaacattttggacaatgactgatgttttatgaagagcttttcataggaattcttatttagttattctcatgttacatgatggggaaactaatctcagagttgcaaatgttaagtgccaaaggcaacacagccaaaagtctatagctggtgcattagtccgttttcacgctgctgataaagacatacccgagactgggtaatttataaagaaaaagcggtttaatggactcacagttccacgtgtctggagaggcctcataatcatggcagaaggcaaaaggcacatcttacatggctgcaggcaagagagaatgagcgccaagcaaaaagggaatcccttataaaaccatcagatctcatgagatgtattcacaaccacgagaacagtatggggcaaaccacccgtatgattcagttttctcccaccaagtccctcccacaacatgtgggaattatgggagctacaattcaagatgagatttgggcgggggacgcagccaaatgatatcagctcgtgagtgagcatcagacctggggttcacatcctcgtatctttgcattctttcccatccattgtattgtgggaagagcagatagttctccccattcccactcttctttgttgtgtgtgtgtccactgttgatgagaatgtcactctttgttattttcaagtttttttagtcactgagctttcccatgattttcataggtcattggaattttgtattgttttatgaaatatacactgaaataagatccttggctacaattacagttttgtataatttagagagcacgtaggcaccattttcttgcccaagaatggggatagcaattcttttactttctaccacataatgtagctgtaggatgaaatcctgtagctgaagtttctcaactccagcccattgatattttgggccaggtgattgtttgttgcaggagggtgtcctgcgcattataggaagttcagcagctaccatggcctctaccctgtagcaccacccgagttgtgataatcaaaaatgttttcaggcattatcattttttttttggcttccaggggatgtaaaattgcccatggttgagaacctccggattaaattaagataataaatgtgaaaatgtacattttaagacaattttccaattcaaggtgttattaggatgagatttaagaacaatagaaaaaatcattgtggcagatgaggtaagcagcagaagggaaaacagggtatagacattaaggactagagttggctgtctcctattatagtcttgtgaaagctcactcatacagattcctgctataaatttcttgcttttgtatttttccaagcaaatatttaatacaatgttgcctgctaatagaacttcccattacagatttaagttttcttttcttttcttttctttttattttatttatttattttttttttgagacaagagtctcgctctctgtcatccaggctggagtgcagtggtgtgatctcggctcactgtaacctctgcctcccagttcccagtgattctcctgcatcagcctcctgagtagctgggattacaggtgcccaccgccacgcttggctaaatttttgcattttttaagtagagacgaggtttcaccatgttggccaggctggtctcaaagtccttgcctcaagtgatctgcctgcctcggcctcccaaagtgctgtgattacaggtgtgagacactgcagccggcctaagttttcatttctttatgaaatactgtgtagcatattcactaccatatgatgaataattaaaactaaattgcaattgtcaaaataaatgaacacatcacatttggaggtagaaaaattcctaatttttttttcccacgtagtttattgcatactattcttatttgtggtatttggtgttatgtagttactcaaagttgttacagcatttatactatatttgttttgttgaattgaaatcatagaacctgccaattaaatttaaaacaatgtcatacacgttggtttctctattacttacagagtaaaattctcaaagccccatgaggcatccttgtcttaatggcatggatatgttactgcatgtgctcttattgtccagccagctggtattcatatataagattttattaaataacatcttacacattatttatgtgataggctttggtgatggggctttgagaaagctgtccagaagagagatgtgagcattctctatgttaataactttctactattttattttaatgtaacttgctacatttgccatctgggatagaagcttctgcatcaaccattaactatcaacaccaactattccaggctgcagaatttcagtttgaaacggttctaaaattctatggaatagtgaaggcccgcttgcttcattgtgctttcctttaagtggagtattgcccagatgtggaagttagatgtggaattttcagacagaactgtttaccttgagaatggctgggcaccttccatttgtactactttttattattgtcagaactgatcaaataaatctgcccgagtatctgtgtgtgggatgcatgttgaaagcgattttattgttgcccaataagtccccaaatgctgtcgtcttttgctttccctctcccatcttaagtgcctttttgcaacttgcctcacaaatcacattgtctctacttattacccaggcttttctccagctggtaaaatggatttttttttcctcagccagattcagagtttgccctgttcttattccctgtatgtttcccttcacttttaatgtgaaaattgcaaatatatttctaaacccttctgcacaacactttccatttatggaaaactcacactatataaagtaacgagaggagatatctaaaatgtgtcttccattttctgctctgtatctccaactggaccaatttttccagataatttctcctttctttccaactttatctgcatcgtagaattcagagaactgaaagcatttcttcctttctttattttttttcatattctttctctactgcagacttcgctaactgatgaaacactgccagagcccacttggactgtttcgcaactttacttaagggaataaaagctctcatgctgaggtaaggcaaacagtccatgtaggttctcactaaaaagaagagtggattttataagctcgggcctgtcttataatctctctgtgtcttgttcttgtatgtaccttgataatttactatctgtcctttttctgcccagtggatttttgaggttcacaaatgtgagatacacaaagatgtgatatacacttgctgttccgtgtttttttttttttgcaaatatgcattttccctccagaactgttactggtaactatcctgagactcaagatgactttaaataacacttttttaaatactatacttagttagggttagacttggctgcaagaaacagaaaattcataagatcaggagcttaaatgagatacaactatatttttctctttgaattaaaacttgagataggcattccaaagctactgtagtgttccatgatgtcagggatccaggatttgtcagacatagcttttgtcctcatgattgcagatggagcataaggacaatgtgttatagtcacattccaagcagaatgtgaaaaggtacaattatttccttgtaaggaaagttcccagtagttgtggtacaactgtgctggttaattctatggatcggtgcttagtcagagggccatgtgtggctgcaaaaaaggctggaagatacgatacagtcctttttcttgtggccatgtgtccagctaaaatttatgtcctctaagaagagaaaaattagcagtattttgctctcaaacattaattttaatatatcctatattttaaaacactgttgctgggtagattgtgaactacatgtgggcaaggactgtgtataataaaaaatattatgttgtcagctcttaacggtgtcagcaaaataatgaataaatattcattgaaaatgtacatggagagatggtatttttatcatgtgaaatatgactcaaaatgagactgattttttacattttaaaacaaatgcacccaaccattgtttattcattcagtaatcactgagcgtatataccgattcattaaagtatcatttttctttctttaattaaaaatcttaaattgatatataatagttttacatattcttggagtgcatatgatattttgatatctgtatttaatgtagtaatgatcaaattagagtaactgggatacctattacctcaaacatttattttttctttgtgttgggaatactgcaaatcttctcttctagcgattttcaaatagacaataaattattgttaattataatttccctattgtagagtcaaatattagaacttatttcttctatctgactatatttttgtgccctttaaccaacttctcttcatctgcctctcccttcctttccaagcctctggtaaccatcatcctactctctatctccctgaaatctacttttttagtttttgtatataagtgaaaatatgtgttgtctttttgtgcctggcttattttacttaacataatgacctccagttgagcaaatgacagaatttcattctgttttatggccaaataatattccattgtgtgtagctataccacattttatctatccattcatttcttgatggacacaaagagtaattccatatcttggctattatgaatagtgctgcagtaagcacggcagtgcagatatctcttccatatactgattttctttcttttggatatacacctagcagtgacattgctggatcatatggtaattctatttgtagttttttgaggaaactccttacttttttccatactggctgtgctacttttacattttcacaaacagtgtataagctttcccctttctctgcattcttgccagcatgtgttattttttgtctttttgataatagctgttctaagtggggtgaggttatttctcactgtgttttttacttgtacttttcttgatggttagtgatattgaaaattttgtaatatacccattggccatttgtttgtcttcttttaaaaaatgtctatttgggtcctttgcctattttttaatgacattattggtttttgctattgagttgtttgggtttctcatgtattctggtgattaatctcttttcatatggaaagtttgcaaatattttctcccattttgtaagttatctcttcactttgttaattgtttgcagtgcagaagcttaaaaagcttaatgtagcttcatgcaatccaatttgtctattgttattttttttgtttttgttgcctgtgcttttgaggccttaccccaaaaatcttttttgagaccaatgttctgtatcatttcctctggtagtttcatagtttcaggtcttacatttaagtgtttaatccattttgagttaattttttatatggtgaaagatgagaatctagtttcattctcctgtatatagttttcccaacactattttttaaatttatttttcatttcaataggttttgggggaacaggtggtattttgttacatgaataagttctttagtgttgatttctgagattttggtgcccccatcacccaggcagtgtacaatatgtccaatgtgtaatctttcatccctcacgccactcgtactctttcccctgagtccccaaagtccattgtatcattcttatgcctttgcgcccccatagcttagctctcacttatgagtgagaacataccatgtttggttttccatttctgagttacttcacatagaataatagtctccatttccatccagattgctgtgaatgcaattatttcgttcctttttatggttaagtagtatcccatggtgtatgtaacatattttctttatccacttattgattgataagcatttgggctggttccatatttttgcaattggacattgtatcagcaccatttttaaatgagactacatgcttttggagctttttctaaaaatgagttggctgtaagtacatggatttatttctcagttctctgttttgttccattggtccatttatctgtttttatgccagtatcatgtggtttgtgttactatgactttgtaatataatttgaaatcacatagtatgatgcctctgcctccagctttattctttttgctcagaattgctttaattattcaaggtcttttgcgattctatagaaattttaggattgtatttttcatttttgtaaaggatgtcattggtattttgatgaggattgcaatcagtctatagattgctttggatagtataaatattttagcaatattaattcttctaattcatgaacatgggatatttcttcatttttaatgttcttttccatttccttcatcagtgttttatatatatatatttttttttgtggagatcttccatgtctttggttaaatggattcctagaattttttttgtagctattgtaaataggattgctttcttgatttctttttcaggttgatctctgctagtgtactgaaacactactgatttttgtatgttgattttgtattctgcaactttattgaatttgtgtatcagatttaagagtttttcgtggagtctttagatttcctaaaataaaaaatcgtatcatctgaaaacaagaataatttcacttgcttttcaatttgtatgccttttctttctttttctttcctaacagctctgactaggattgccagtactatggtgaatggaagtggtgaatatgggcatctttgtcttgttctagatcttactgggaaggctttcaattttaccccattcagtatgatgttagctgtgagtttgtcatatatgaccttaatcacgttgaggaatgttccttctatacccattttgttgacagttttcatcatgagggctgttgaattttatttcatgcacaagtgttgtttttcttatagtgacttctttaaccatttatcaagtcatgttttggatttctccttaaaaatgagtctcagacttaaggttcaaaacacctatggaaataattctctttacgactaatttttctctttaagcctacttttcttcatttctcagagaagttatcttgctctgataactttttaactcttcctaaaaatcaaatctccccccaacaagatggagatttggtcctgctgggggatttttaagtaagggctgttagctgtgattgaggtgcctgtatatatgagacaaggagccttaagggactaggatcaaattaattaaaagtcacatttattgagccctgccattgaagaatttataatgtcttctatgcaaaccaattcattggtaaggaacagcattgctattctcagcattttggaaataccacaatgttggagtcgtctcagaaggatctctgaagagttctgggaaggtgacagtcaacagcagaatagcagctgccaccacagtcaagcagttggtttgcttggcttggaagttttagacatcaaaggagtatggcttcttcaatactaaaaccagtgacaaaattgcaaaagttatttttattcctcttcaaatatgagcaaacattactgtgattcagcttatttttatataatgttacagggaatcaaattaagaattaaatgcattttttggcatagttatgtcttgtaaagaaagaaagatggtgccaggggaattttcctttcaaatatgtaaagaacttctaatgagtgaacctttcctgtgtcggaaagatagcattcacctcctttcctggcttctgtgccaacttacgattgtggtgtgtagaaatttagtgtcagccactgaaagaactatttcctaagatgatactgctttttactcaaggaataagtaggttccctttgaattgacctgtgtgtgtttggaaaacaagcttaaatatctcctcttctcataggaagaacactatttcaaagagccattttctttcctaacaaagaaattcatactgcagaaaaatcagcaatttcacagctggtttttgaaatcctgaaatgatgtatacaaatcaaagcaggagagattcatttggaatgaaaggaatatttgaattgcatcccagtttcgaataggatattgtttcacggttctacagtattataaacatgtcatgtctgttatacatgacaatcatatctcatctgtgactcatgaactttataagaaagtgacaatttgaaagcatagaattgcaggattggatggaacgatatcttctaagttatttccactccttttcccatttttggttgaccatgctaattcccctctaaaacattcttctgtagctacttgaaaacacccattgcttcttaaagtaacctattgtcaaagaatattggattttcttatgtacattgaaaaaatgacactttattggttttgattctaccaccaagagtcacagggaactttctatcttttcatcatatatataacaggcttttcatcttatatgtaacagtccttaaatattttcatattgtaataatttcctatggaacctgttgacttttacgctagagttatagtgatggaggtaatgagaagtgatcatattctggatatatggcagcagtagacagaaggtgtggttcataggaattgatcatggaatggatgtgggctgtgagaaagagcagtcaatgtttttgacctgaagatgttttactaacatatgttaagcatttactatctgctcaatatactttgctaggcattgtagcacaattaaatgtgcatttgcatagctgttcgatgatacaggtaggactattctctaagactaagagaacattagtcaggcctcttatggtgagggaggggttccctttctttccattctcatgctttgacttgagagagcaagcctatatgttattatggatcagaattgagatttcatgctcagttttaagtctaaaaatatgcttttcaatatctagtatttacatgcgtgtgacttctcaggaattataacgagagcctgaaaaattaccaggggcaacattttcagtccggagatgttataccccagttactgccactaaattttaagctccttgggagcaggaatttgattcttttattatattaatagtatctgttacataatattaactcagtaaatgcagggtatgctattgtaaaactatagtctcagtctctgtaagtggattttttaggatagactaggtcctagttaatgtgatatatctctatttctgtctatctatctgtctacctacctacctatgtatcatctatttatctgtcaatcaagagaagaaaataaagaagcactcttggagaatcaaaattttttataacatggtatgcaactcccttacgttctttatcagccacctgcatgcaaacagcattatgtctgaagttaaaacatgtaagatatatgagagtggaatccttggtgcatttcactcttgaactcttgtctatggagtaagtagcctgggggtagtttctcctcctttttatatatgtggggagaaggaattaggtggctgattatcttgtgctaaataggtttctctgccgatccacaaggtggcagggagtccttagtgccactatgacagattaaccaaataggcatctgtcgaaatgtctgatgcattagttgcactgcctgtaaaagagatgggcctccttgagaaataaatccacactgaatttcaaatgtggttgtgtccccaaaattagcaacgttttcaaaggtgtacccttcaaaggagagcagaaataaactgtaccttaaaagaactagtgctcagaggcctttgtttaatcaatggttagtttggtggtgattgcacaaattcactacattaaatttaatcagggatgtttctggtatgtgggtggcatgcttactgattaattcatttatattcttgaaataacatatgttctcctggatgaatttccacagtttggtaattccacagcatgcatttcagcatctctaaatggctgttttgttcactgtcccagagcctaagacatgctgggtgctgggtactgattagtttaccagactaagaatgacagacaggaaatggcaccattttaatctctcagaagaacatcagaggaatcatttcggtggctgtaaatacttcaggattttgatgtcaccttttcaagttgctttaagaaatcacttaggaatggtttgggagaccatgatacaatgaggtcccgcaaagaattacacctttctttgtcagggttctgaaattgattaagtataactatgtccgtgatgtaatcgattacattaaaactatcattttggagaaaagagacctgatggattacagagtctctacccttatttataaaaaacgatgaaatgaaactcagtagttcattgacttttgtagatggaaagatagtttgtagtagagctttgcattcaggactagtagttgccaccaccccccgcccatcccctattatagccagtttgtttgtttgtttgtttatttatttatttatttatttatttatttatttatttattttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttatttatttactttaacttttattttaggttcaacgacatatatacaggtttgttatataggtaaattagtgtcatgggggtttggtgtacagattattttgtcacccaggtactaagcctagtacctgatagccagtttaaagtgtgtacattggggaagggggggaatgaggttgttcttagacagttagaggcacagagggtatatatatatatgggattgccttatgttaatacatcacttggctttaagtgtgggaatggacaggagtacttgttatgacctgtggggccctactttccttcattctcagagagattttgcaaattgcctaaaatatctgttaatatgctctgtggctacatgcttacagacatgatgacaaggaggggggaaaatattgttcattgttgtcattttctagctggaaccatgagatttgcttaaggaagactgaaggctagtgtgacagaaaatggagctcaggaggacccagaataaattacattcctttggagggtcctgagaggggcaggccatggcttagttccttctattccactcatttcttacagttcagctgcctcccgatgtgcagttgtttagtatgcaaatcaataatcattacctatgtgaagtgttagttcacaggcgtgcaggctgtggtcagttggtacctgttccctcctaaagaactatctctgaagttgaacatctctgtttttctttgtataaatctgaatattaattagaccactgcttattaacttagggacctctctgcttttggtgacagtagcaggcagaatatagatggtagaaaacgaaatatcatgctgtttctgtaaacggtttggtgtctccatataataaaactctttagaattaactgcctccagaaacagggacaaatgtgatgtcctttctctgccccttgaattaaataacaaaatgaacagcagatcattttgatgttgctactccataaagatcattttgttattgttactaggagagagtggagtgtaatggaaagaatacatgtttacagctgggctgtaatcttggatcttctgaaaagtaagaatatgttcttgaaggaacctcaaattttgtgaatgtgcttattattttaaagataattacatggattcaatttctgtctccgtagtaacctgctgtattatctttctctagctatataatctctctttgcctccatttcttcatttgttaaatagggataataatagcacctatatcataggtttattataaaaaatgaaatggattcacatttttaatgttctatgtaattacttatcattgttgttttaatagggaaagtattggttatataaatagccaagaaaacagccaactgagacttttcttcctagattaccttggttatatcagtgcttctgggtgtggtcactgatattctacagcagaaacagctagtggggtccccaactaaagaatgtatcttattggaggctaagaattatgaggcaactatctctgacttgagaaccctaaccttatattgacatctgagatttattcatcaataaacacctttttgtaatccagaatcatgttatgtcattactttctatatcagaatttaaatgttaagggaccaagacattatgcaatgaatactaaaatgttactaaaatcatgtgttgtgaagaatatttggaaatatggaaacatgttcacaagatgttaagtaaaaaaacaggttagcaggttgtaaaacagtatttcagtatgattctaaattgcaatcattaaataattttataatcatgaaaaatgttattaaaatattataatcctgtgataaattctaatgagtactttcttgatttggctttaacattttccaaaattaaaattacaagttttttttctgattataacagtaatacagcttactactgtagctattacaagcaaaatagaaaattaggtaaagatgattaaaatcatccacaatcccagtttcttaaaatggccttactaagatttttaacaaaaatttactccacatatttatttatgaatttttatatgcaccatttctctaattttcctaaatggagtttataatatctacctgttttcactcaataatatattgaactatatgttgaccctcatcattgtcccaaagtttaaagtcattgaatagagatacagcaatcacttactgatggagatgtgtagtttggttgtcttacaatttgtacattaaagttatactatgataaagatctttgtgcataccaatttaccctaccaaaagatatgagaatatttccagttgaattttaaaatgaaaacctcattattcttttaacttactctcatttgattattgaggtggagtatttttccataggcgtctttgagcccctcaacttgacaattgtattgacaattattcactgtatgattatcgtgattattgcaattaagtgattacttatggtttctcatttattggaaggagcattgtaagggtagcagaaacactacagagcctttttttttttatttaaccactctcttgccctggacatgaggtggtgattggactctcagatgctgcttttgtaatatcgcatggtcaaatcaagccctatcaaagtgccctgtcatgtcctttcatatctccttagggttaagtatgtccccaaagccctgcgtcttgaggtaggcatgggaattatcttcaaaaatatcaacataggatataactttctctcttagattagctaagcttagaagaaaaatttctttgtggtcaaatgtttctgccatattaaaatctacaagtcaggtggtgaccagattttgtgatgccatccaaaaggttttagtacaaatttttcttaaaaatgcagtaagtaattgtaaactgtgatacttttaaattatctgcaagattattccatgaccatttttaaaatagatggtttttctgttgtggtcttagttgtcattttatagttgaccccacgtgtaacttttcgaagactctcaggattcccttcagtcctattctgtgtatctatctagtcattgtcccagtgaaatgataaaaggcccaactcagcttgttttgcaatgtgggcaacaaacatctcaataggatgtgtctcttccagttgtttttcttgtactattgatgtcttatggggagatatttaacttcacttcttggtcttattcgtagcaacttccatgactgatgagccagttgaattagtctttgggatagtcactaagtagatgggaacaggattttcttggttggaagtccatttcttgaatattcaagtttgtttgtcctagaaatttaattgactgagcctgcctagtaaaggaaatctttgtcatgccagtgtgaagttctgcttcccactttactattttcctcttaatgcagtactaatatatgttgaaccaaaaacaaaaacctgggcttatagcataacacacctggtattaaattgtggtaccaccatttgttatcctggttagttaacaactttctgaaaataaaataaggataataatatctatcttaatgtatctttttttcttatgaggtatctaagatagaagaatttctttttctttgccttcgcttaatagaggttagcattattttattttatataaacatagaaataaacatctgctggaaactcatttgagagaaaacaacccatgttggatcttagggaggtagatacacttttccattctttcttcaatctacagaggttcatgtcatacccacatcttcatctaaaaatcaaggaatgaggctggataccgtggctcacgcttgtaatcccagcactttgcgaggccgaggcagacaaatcacttgagctcaggagctcaaaaccagcctgtccaacatggtgaaaacctgtctctactaaaaataaaaaaattagccaggtgtggtggtgggtgcgtgtaatctcagctactcgggagactgaggcaggagaatcacttgaacccaggaggcggaggttgcagggagccaagattgcaccactgcactccagcctggacgacagagagagactccatcaaaaacaaacaaacaaacaaacaaacaaacaacccaggaatcattctagacattatttgtttctcaaatctgtaattgttttaggatctatgtttgttttcttttcaccaaaactaaagaaacactgttccttatttgctttttttttcctcagtctggctacttacttttctccctcatagacaaatgctaacaaccaatgaatcaccatatttctcctttattaaagctgtctccaatggcattctcagcaagttaaaatgtcaagtatatgggcctttaagaaaggtttcaaaagatatccctggggagggagggaagagaaatttgaggagggaggagggaagccatgtgacctgagaagcaggaattctgtacataaatactgaagtttactgtcaagcttccgagtaaaaatgttaaatatttgcagtgtccacaacccatgtccctgtgataaggctggttaattcctagaacataatgctaggaattcaagaatggggatcatatcctgagtactgatgatccatcttgatactgtgtcaaagggcacaggatgaggaatggaagggtttggagagtgagaataaattactgcaaatccaaacatctgactggataaactactccaagtggatatcatttattattcactccatagaaagattagaatgtacaccctagggagattaaggtaagagtaagagagatgtctaaacattttatgtgtccatcatctacgttgcctgtttatcagagtctgtcactataatgtttactgctgtaagtggttaattatgaatatatcagctgaatgctttcatgtcagttgagctgtgcagttgccacagtgagcactcttttcatgtggacttttggataaaccagcgtttagagattgtgttttataaattatatgaccaaattccaataccacatggagaatacgtgatttatgtgctaattggatcatgtccattagacatcctcataactatcttttatcggcactacagtttttatttactaaaacatagtcacatgaaagtttcctataatagtattctacactttctattctctgactcttaggaatcactactccttctgaactcctttagcaatgaatttcacaattatatattattaatgtgaaattcacaattatatattatatacatttaagtatatgcagtgagtttcacaattacatgttctttcatgtgtttatttttctcatcaaaaaattaaatcttggccaggcgcggtgggtaacacctgtaatcccagcactttggcaggctgaggcgggcggatcatgaggtcaggcatttgagaccagcctggccaacatgatgaaaccccgtttctactgaaaatacaaaaattagccgggcgtggtggtgtgtgcctgtaatcccagctactcaggaagctgagtcaggagaatcacgtgaacctgggaggtataggttgcagtgagccgagattgtgccactgcactccagtctaggtgacagagccagactctgtctcaaaaaaaaaaaaaaaaaacaaaaaaaaatattaaatcttgatttgaaagatttgaaatatcaggtgagtataaaatcattggtaattctaacaactgaaattaataatttcaaaaatattgctttttgtatgtctataaacttttatatattgaaaaaacgtatatatgcaaatatgttgaattcatgtcatatctttttaacattatctgcattataattttgaatatctttttgcttaattaattaatttatttttattatttttttttgagacagagtctcactctgctgcccaggctggagtacagtggcaccatcttggctcactgcaacctctgcctctcaggttcaagtgattctcctgcctcagcctcccgagtaggtaggattacaggtgcaagccactgtgctcagctatttttttgtatttttagcagagagagggtttcaccacgttggccaggctggtcttgaactcctggcctcaagtgatccacctgcctctgcctcccaaagtgctgggattacaggcgtgagccactgcggcaggcttctttgcttgatttatgatcttttaaaaaatttgtcatgctgggtcaattaagtggtaggtatttagaaagtaagactcttctattttttaggatctctgtggcatagtgcattgcaagtagttctcaataaatagcttttgttgtaaactaacacactggttactttctaaagtcatttgctcttttaaaatccctttggtatactaatctatactatatcactatacttgtagaccaagggatttgtctggccaacatggtgaaaccccgtctctactaaaaatacaaaaattagatgggcgtggtggcgcgtgcttgtgatcccagctactcaggaggctgaggcaagataatcgcttgaacctgggaggcaaaggttgcagtgagccgagatcgctccactgcactccagcctgggcgagctactgcactccagccaagggtttggtctacaaatatagtgatatagtatagattaattcagttgctttaaaaaaatccatatgccacaggatggctcaggatatcaatctatatcttagaaaaattattatacaaataaataggcaacaagattgagaaaaactggtatatttggtaaaaatacaccaaaaaagcaagagaggaggagggagatatgtgttttagaacccacacattttcaccaggtgaattttaaaggctataagagttcataaaatcttagcatcctgagtcatttgagagtctgataaacatcatttaaatacgtaatttaattgtttctcttttcttgttagagaaaggtggtgcaaacttattcctggaagacggtcagccatattaataatgagcaaaatgcctattgagttggttttttaaatactaagaaaatgacttttgaagttaaaacacatgctaactgttgcttagttttaaatatatatatatggagtggaacaaaagttcccactcaacagcttactgaaaaatacaaaaaggaatgcagttttcagcaggttctatttgccataaaacattttcttttcttaccattgttttatttttttctttctggtctccccctcttgccaacgttcacagctggacatctttgtccatctttcaggtactttgtgttgcatatccgtacgtgaaacacatatatgcataactattcaggtttccctcctgtctccattgttggcagaattctcattcaagttaacattaatatacttttttgctcttctcttcctcctggtttgtccttttgtcacttggaaaatattgatttccctccattgtaggtgagatgcacctacatggctcatttgtgcttacttccttcttgtttggagactcagcaagttcagcacaatgctatttattgaatttatctgtcaatttcttcttccttgcatggctgactaattcagtggaatcagcacaataccagaagcacagaggataatggcttaaattttttttttcgcagaaaattgtaaatcaaaagtagagactaaatttgaggaccaatcccttcagaaggttgcaacttgtaaagtgtgtgcaggactgtctaggtgaacatggcaacagatatgattttctaatggggcacttctcagcttttcattaaatgtctaagaaatacacagaaagacatgaattggcagcaggattgtgaaataaaaatgagaggagcctctaacataggcaaaaactttcctccaaacagacaaacaaaagcgtataatcaatgaagaaataaaaatcagaataacctcattttcttcacagtacaaaatactaaaaaatcaacagagttattttcatgaatggcttagtctttggaattggctttggacatgcattcctacttcacacatcccagtgaacctcagcacattagctggttactgagaaggtaggaaagtaaactgacctttaccttttgtgaactgggtgctacttactaggatcttactggtctctttctgccaaggtcagctcctcttgtgttacaacagagaaacgactaatctcagaatgtaacatgttttagataagtggtatggagaagcagtcatgcttagttgttgaaagagaagtatacagtatgcacaagtgtatacttttgtaagtttttatgctgttcaaagaagaactttaagatactattacagcatagtcattaagagaaaagatgttaaatagacaagatgcttttgaattgcaagacccctgtgcctaatcctgaaaaagttttctaacttctttgtgccttagtttcctcatttgtaaaatggccattaaacacttcataatattactgtgaggattaaaaaagtaagaactaagtccagtgtttggtaactgtagtaagccctagatggatgattgtcactactgttatttaccctaaataaattcaatatttatctttagttattattataccacactgttactaagttaggcttagaaggaaatgactccctgttagctttgaaggttgagctacaagatcatgcccatcaagttaaaattaaggttttgacctgacaattgaaggtgcaagcctagagagattaccttccacataagcttaatacctggcctaagtggcttgctcacgttatctaagtagaaacaaactgaaacaaacaaaactaataatcaaaactaataaaaacatccaaataaataaaattattgattcaggcaaggaataaggattaataaatttgataatgaggggctggataattgtataatgtcaaggtggaatcacacgtgtaactttctaatcaaagaaaaaaaacacacactggagagatcctactatttccatcctattccagtagtcagtcagttgttatatgccctgggatataatgcaagatataatgagcaactttcacaatgtagtctagtcaaaaaagttttaccaacatcagatcattaggagatacaggagatagaagaacaagggagacatcatcacatggatgcaatcagacaaatgacacgtgcgagacattctgtgaaacagcagacctggtctcttcaacaagtcactgtctggaaaaaggactgaactatattaagaatgactgaagaaacagaatcagatgcaatgattggtcttgaattagatacttattttgtcaaaccagatgaaaaggcatttttgacaggattgcctgtttttgtaacccaaaatatgcattgaaaaaaataagcaagacttttgttaaaatatctttagacagaattttggtatatatatatgatatatatgtgattatatctacatatatctatatatatattctgtctaaaaattctcacaattctgtgtaaagatattttagacagaattaggagatatctgtatctagctctagatatagctaaatatatattcctttatatatctataaatctatatatctagctatatatatttagatatatcttgctctagatatatatctagctcttatatatagagagagagatagatatagagctaggtatagatatataaaggaatatatatctatatagtatgtttatgacctacaagtattcttttttgatcaggttttcttgaacatcagatatatgtatataccagaccattcaacatgcatttatttttttatttttatctttaaatagagacagggttttctcatgttgcccaggctggtctcaaactcgtgggctcaagtgattcacctgcctcagcctcccaaagtgctgggattacaggcgtgagccactgcacccagtatcaacaggcatttataagcataggtataatctagtgctcttgattgattaaaagtatattttgagaattgtttattgtgattgcttgaaaggtgattattataaaaatgagtaaaataatgaatcactactcccttttttgtttcttattttgtttgtttcttccttttgtactcaagtaacaaaaatcttaatttagctctgaggatacaaatgaagagtaatgtttcttgcccctggtcccacagttagtgacagacagtcactaaaaattgaaatgcagacagtccaatttcagaaaccatgctcttgaccaatacattgaagggtctttagctattagctgcctataaaatatgtggtcataaccgtagagaacacagcaaaataccacaataaaaaaggataaatgaaacttcactatttttcatggaaaaacccaacttgtattgcctgcttcctttgtcagctttgagaacttcagtatgaagttttgtacctatagctccagctcctgaaaaaattgttccaaaagcctcaacaccagttaaattaagttcctgacagaagttggaaacattatgagaatgacacacatggtttttgttcagatcatctggggaatgcacgtcacactggcatcaacctccaacagagccttgggatgacagaagcagccgttcggaggaggcctctccttgctctgttagtgaaaagttgagatttggatggtatttttcacactcttgacagtttatgacacgctgatgggatgaaacagagagactgcatactaaaagttggctgtgacctaacaagcaaagttacacaagtcatccctggtcacataagaggtttcacctcctcatttctaaaagctaattattactagctttttgtgattaccagatatacctcttccattttttatacctcctactctcttaacatggacagcattgttgaactcaggatctgaagtcagacagcattgtcttctttgagcctcaatctgcttgtcaatgaagtagggatgatgacaattctttccatatagtgtagttgtgagcatgataaaatgcctagtacagggactgtctagtaactcctaaccacaactattatgcttgttagtccccatggcctatttattttaagcccaaagcatcttctggagctaagcactgtaatgcccttgaagtgttttttaatctcttcagttctgtctactgcacgttgtggtcttacactgctcctggccactgttgagttattcctaaaggaatacagcaatttcagaggccttctgaagctccctgtcatgcctggcaatgtcattatataccaactgatacgtttttacttttcccaattcttgacaaccttctatagtagtatttcacatatctgcttggaaaaaatatttgggtaacagcttttggtattgctaggtgttttcggttttcttcttacctttttgtttatcgtagtataattataggaattaattaatttgtcgaattgtgttatttctctgctcgtctagcatcatcttgctgtatggagataaagagcagttaattttgagtaatatactagaagtttggtattcgtgactctcatttttggtgaaccactctactgactcaaaaacaaagatttttatgtgctttgaaattttaataatcaggtaatgtctaacatttcacattttctccaatagccactcttttttgcttttatttttgcatataatcctgctccatttctaaaattgccctttgaaattttcttattttcctacacattccagtttattactatgtggaagctgataatatttatactttgttttctaggaggtcattgatataaaattttattttatggttgattttcttgtgaatgggtgttttacacaattttcaagtaattggcgtggattttatgaggccagtcaaatgtagcaaacattataaaattactgaaaatgtatcagtgatgacaaatatttaatgattggtttattttgattggtcgtagttccatttttctctaaggcatcttccttaaaataagcatatataaatgacctttaatgtatacagcatgcattttttcattctctagcaatgagagcaagcacataatgttgtgatcactgttagcccatctgtgttttaacatgctctccttagttttattctcctgtgttgttcatttagtatatggcctcattcttccacttttttttctgttttgatgaatagtttggataataatgactgacccaaggtgtgcaaatgatttaagcaaacaaagcaaaactattccactgtcttttgaaatgtaggcttcagggtatcttgaattgcattcaaaaagataaaactcttcatcagaattaaaaacatacgtttacacaaaatcatgtacacaagttcatagcagcattatttgtaatagccccaaagtagaaacaactcaaatgttcatcaactgataattcgattaaacaaaatctggcataaccataaatggaatattattcaggcataaaaaggaatgaagttctaatacgtgttacaagttggatgaactttgaaaatatgctaagtgaaagaagtcatatacaaaagacttgcaaggttctatgccttcatgtatatgaaatacccagaataggcaaatccatagaaacggaaagtagattagaggttcctaggagccaggtacagaggggaatggagagttattgcttaatgggtatggagtttctttagaggaaaaaattctggagtggtggtggctacacaattttgtgaaatatactaaaaaccattgaagtgtatgctttaaaaaggttaaatggtaaatgttacattacgtgaattttatctctaaaagcattttaagagaagacattataataaacagagagtacaaagatcagaagacaaaagaaattggtggaaattatttgacattatgaagagcattgtaagtctcaatttcagggagaattgaccataattgacaaaatattgcataaataatatcagggatgcatttggataagaaacacatattacaatcctttataatgttaacttagtatgtattccagtttccacaaatgcactccatctcccccaaagtataggcaagtagtccttgaaagttggaatggaaagattaagcaacattttcataaatatgtcactgaaacaggctcacaaagcagtacatgccatataatgggaactggggtatagaagagaggttaatcaatgctgtatagctaaactggaagtaaagagggatttcataagagaggttccctttaaacttgttttggaaggatacataggagttctccatagtgtggataatgagggaacaatatgagcagtaagaactttcatctaacctttaacttctttcttctatccagaaagggttagtcaattttgcattgagcaccatcacccattccctaaatacaattcaaacggcttacaatccttgtttttttggtttggtatgtaaggtttagttttcctccaacttctgcatttctcttcaagggaggccattaaaccctgtttttatttctaatctacaaaagctaaaaaagcatatttccctttatgaatttttcatatgctcatctgatgcttgtgtgctctctgcccctttgcctggcctgaaatctgcttcttacttatctagttcatctcttgctatttgccaatgcaaatgtgggctaaaaccagctgaaacagtaagggcatgttagcagagggaaaaaggaaaggaaaaagaggcaaatagagtaagtacccaaagaaggaaaaagagcagagatcatagatggctatatgaggttcaggcagaggaattaaagaaagtgaagaaatggttgggaagaaattagaatgatgcctgtagactggaagcagtgaaggaaacaacatcagaaattggggcaaaagttaagaataggaaataagcttttactttttaactgtgctgcaaggatgcaaaaccaattaaattatttgaaaatgtgctttattttaggccaatctatagtatacatatcaaaacttagcttgctctggtgttcaaggtggctttatactgtttggctatcctgtgtttattatgccattaatccttttaactggtctggaaggcaatttagttttaagtcagttacttttttgaaatgaatcttatttataccaaacttctcatgtttgcttgaatttaatcaaatttttatataaagtgtaatttcaaggaatttataatggagcatcaagggaggagttggttatgtaatcatacttttgtaattttctattgtggagaaatttatctgcttagttattgaaatcaaattcctgcaatagagctattaaaatgggctagcatcatctttgagaatgttccttcttaaaggtaatataaattatatccaacaggagagaaaaagttaacttatgaggtgagtagactaagagtcattaaaaaaatcttgaggaagatttttaataatatgtaaaatatttctgatgtggtagcataaatatatattataggacattattaatagtaaagtgatccaaaacatataccacagggagatgacttgaaaaaaatgcattaatgcttcatcagttgttatcttagggtagtgggtaataggatagtttttattctctctatatatatttttgccagattatctaataagatacgtttttattaataataaaaagagagacaaatgatacaaattttagaatgaggactgctcagtctgcataaaaattattttcttgcaacaaagatgcactatggaattcaaaaatggtggtaactattgtcaaacatgtagagattggagttcctaactgttgcaggaagatctaagataaagtactacaagatgagtaacaaatacatccttaaaagcccatttaaggagttcttaatcgcaaaaaatttgaataggatttaatttgatgaatggtctagttaaccaaaatagtttatctggttcagttactgttgataaatatatttaacgacattgcaattgcatattattcagccacaacataatttcattaatgactcattaaaattattgtgaaaaggaaacacttaagattgcattggagcattgggatacctcacagtttgattttttcttcttcctctccctgcacattttttacttcttatatttaagtattctgctatgattttaaaaactagctacaaaggggagataacaaaatgagagccttctcatattaaaaaatatcgtttcttctcctaccccttatttttcagtgtatgttcacattaagaaactagaaaaatctagataagcagagccaaggtaattagttttctgtaattcttacacgaagagatcatcactaatgtcattttggtattatttactgagatttgttttttctacacttaaataggcacataaatacatgattatgtatttctcacactgttttatggcctgtatttcacacttggttttataatatgaacatcttccatgtcagaaaatattattcttcattatactaatggccaaatattattccatttgtagatgtatgtacttatttaactaattttctgtctcttgaagatgaattcctgcagtggaattgctgaatcaaatatgtatatattttgatgctttacggcattaatacattttcccttaagaaagttgtatcaatttatacatctatcatcctcagttaggtacatccttgctgactttgggtggcttttttattctgtttcccatttttataagcaaaaatggtattatatcttctttaattctactggtaggttgaacttttaaacatttaactatactgtatttctcggatctcctgccgtgtgtgtgtgtgtgcatacaccccctgccccccccacaacatacacatacaaatacatatttggactttaaaaaacactatgaacttgaattttttggttgtgtatacaccagtttctaattgattagaaaaatgagaaattctcttttttttaagtatataggaactaaatcaaaatattgtgaaacctgaaaagaaaataccacaaccccaagcagaaagggcttagttagctttaaaaaaactacatggttgttaaacaaggcttgtcaagctattaaaaacaagagtaacataaaacttacaatttctaaataggaccactgtttctaaatatgttaagtggtgtttaagtcagttaaatcttacagccaaaatgttgtattaatgcatgagtgagatgcattatagatgacttgataataaagttatgtatgtttacaacagagcattttgttcttagaacatagtgggagcctgaagtcttgggattatccatgatcataattgaacatatgtttagtttactctgggcaccatattttcaaagggacataaatgaactagagaatgcttaaaatgttgggacatggttaatcatagtgtcacatgagaaacgtttgaagaaaccagggataaaaaaagccggaatgagttaagattcaagcatggcatcattatatacaaatgctagatgagctatcaatgcagatttcaggttttgattgtacccctgagatggattaagcgtttgtaggtagaagtatgaagaatctaaacagttttgtggagatattcgtagttagatcaaacattcccctaaaaatgttcagggcacattgtctcactggaactctttgttcagaaactgaacatttacttagcaaggcttgttgtagagatgattttatcatttgatggtagttgaactagctaagttttacactcattttcagccctgaaattaaaacaaacttgaacaactggaggaatttatgccattatacacattgtaactctagcatacaatgcgtgaaaaatatgctagtttttttcatagcacattttaaaactgaacatttgaaatgggctgtgtataaagataaatgaggctgggcacagtggtgcacgcctgttatcctaacactttgggaggccgaggtgggcagaatgcttgagctcagaagttccagaccagcctaggcaacttagtgagacctcatctctacaaaaatcaccaaaattagcagggcatggtggtgcacacctgtagtcccagctacttgagtgggctgaggtaggaaggtcactggtgcccgggagatcaaggctgcagtgagctgtgattgtgccactgcactttagcctggatgacagagtgagaccctgtctaaagaaaagaaggagaaggagaaggagaaggagaagaagaagaagaagaagaagaagaagaagaagaagaagaagaagaagaagaagaagaggaagaagaagaagaagaggaagaagaagaagaagaagaagaagaagaagaagaagaagaagaagaagaagaagaagaagaagaaggagaagaagaggaggaaggggaaggtgaggaggaagaggaagaagaagaaggctgatctgattgactttgtgaactatttatattcatctattgttgcttgtattacattgcaagaatacaaaactaataaaaatgtatgaacttattgtaaacttggtaaattgagaataaagatctcattttttttgtgttaactttataagaatctgtgagagccagaatgatttcagacactgatgacaattttaacagaaacataggcgtttcacaatgcagtgggaaaattaatagcagaattagaaaataaattagaatagatattagttgaaataatctgaaatgcatttgaaaggaaaataaggaacagagatttcttagtccatttgtgttgctataaaggaatgcctgagactaggtaatttacaagaaaagaagtttatttggtttacagttctgcaggttgtacaagaattatggtgctggcacctgcttctggtgagggcctcaggctgcttccactcattgtggaaggtgaaggggagccagtgtgtacagagatcacagggccagaaggaaggaagagagatagaggggaggtggcaggctctttttaacaaccatctcttgcaggaactaaaagaggtagaactcactcactaccatgaaaatggcactaagccatttttgaggtatctatctccctgacccaaatacttcccattaggcccctccttgcaacattgaggatcggattcaacatgagattttgaggagacagacatccaaactatagcaagaggaagttgctataaaaacagatcaaagaaattgggaaagattgcaacacactgagatccttaaacagtttccatttcaaatggaatagataaagccatactaagtataaaacaaaatataatgaaaatgtatgttatcaaataagtggaaggattgtaagaagaatatgaatctggaaatcagaatgaaagaaaacaatacaagttttgttttgttggtaggaaaatgttggctggaaaatgttaaataaagatataaattagagaaaagagggatgtttgtcttgaatgttcattcagtgacatagggaaggtggtgaaaagcaagaaattccaaggaatagagttaaatgaaggcattttatatgagtattaaagataggtagcgaaattcaaggtacacagaaccatcttaaggtctgaaaggccttaaaaataatccaatcccatacccagtgaatggagcttggccctatattcttgagaagtgcttgcttagtatagactcaaaagtacatttcttataaggctatacatttatagttttaaacagcttcccaatgcctatcatacattcgctttagaaatattttagaaatattattttaaaaagaaatattttagatgatttctaacatgaatgatggagtgataggtacagggaaggatgagagaccaggtcccctaaaacccagagagactaaatgtcatttgggacttttgcacagaaagaggagcatggatttgacctatgtttctcattgcatagagatatcctaggaagatttcaaaacttttgtatgtttagttttctcatctgtgaaatggcgataataatagtatctataagacagagtttctataaggattaaatggatagtatatgtgaagaccatatcatggtgcatggcacatttatgatgttcattaaacgttgctgttaatatatgagaagggctgaagacatctgctttaagtcagcatttattgaacacagttcaggggaggaagattggattacataagatggtcttcctgtcccttcaaatcaacttgggatttttttttactttgggcagctacctttcaaccttcagtgcttcccgcttccccgtataaatataagagaaaataagataatgaagaatgaactataaaacaatttagaggcttcttgcaactatatctggttttgatctctttctaattttattccacttactgcatttctaagaatagtcattgatgtgtaagttattacgatagtggctgaataacattaaaaatattttatcatgaagtagttctttctagacatttgatgattgaaaatttcatactacctctcggaaacttggaggcatagttttcagggttacagaatgttcattattagtatttagtattttttagattaaaattcccatcttagggtgtaccttctctgagccagtcattttcttagattttgaaacttttctacacctaacacgatggagtaacagggactggatttatctttctgcccaaaataacaacaaaaatgtgggaaaaaatgaaacaacagtttctagacagtaaacaataacaagcagcacagagcattgatcccagaaacaggggcaatgaaagagacaagcgttagaattgtcctggcttacatttcaaagagagcttccgggccataatgcaggaagggggaagccaggtggatcctggaaatatccagagtgattatgagaaactgatcaggcttgtcttggtatgttatgacttgaataacactgcactaattgtgttttatggaattgacattggaacattcatatctttacatttatacgtacaacacctgttaatgaagtacttagtaaggtctgtggttgcagttacaggggaaaatcattaacgatgatggtgaagcaagaaaggctggataaaaagagagaaagacgatacgtgagacctaaataagtgaaaaaatgaggggtccattcaagagaatgaaaaagttcagtttgaatgaaatcacaattgtcaaatcagagacatgatgaaagaactacaggtaagccaggctacacagggtcttagagcatcttaaagatttgtgtattgttgcgagggaacaggaagccattgaagagtttaagcagagtgtgagatcattgagtatatactgctggggtctttggatgctaactagagataaccattaaaattttctgacttaaatctgatgagaggaaaaaacttatttccctttcaacagaaacttcgggtctgaactttgtagagtttattgtggctaaaatgaccacgtttttcaaagaaaaatcgacactataggattttttaaaatgacatgtgaaagccttacattataaattaaatcaccatctcatattcagctgcattttttaaaagaatccaactatatatattgagtgtcttggtcactttggtcctgacttatactgtagctgtacttttgaataactgcatctgtccatggccactgagaatctagaccccatcactgcagatgtgatgatatttttgttattcttatttctttgcttggatttatgtaaatttttttacccttccagcctacctaactacattataatttttttggtatcagggagtatataaaggctgtgttcgtccccagtgctaagtacagaccctaggcattcaatacattcttgttcaaatgaatcttatggagaattccaacccatataggagaattctcactattcaagaatttatctccaaattttcagcatcatttaaaaatgacaaataaattttgacatgcaattagactagcagagtcaccctagttacaactggttcctatcctctccccctttagatatttgaagaaaataaagtatgttaaaagaactcaaaataaatttttaattatgatattatgattgatgattattgaatgcatgctagcttttttccctactgtttattctatatttcaccataggataatgctaatataaaattattaaaggattaattcactgaagtccttatgataaagtatttggggatccctaaaattcttctgagttttaagtggcttatttgtgttgatttgttttgaactataatattttattttattttattttatttattaactttttttgagatagagtctcgctctgttgtgcaggctagagggcgatggcaggatcttggctcactgcaacctccgcctcccaggttgaagagattttcctgcctctgcctcccgagtagctgggattacaggcattcgctaccatgcatgactaatttttttgtgttattagtggagatggggtttcaccatattggtcaggctggtctcgaactcctgacctcaggtgatccacccgcctcagcctcccaaagtgctgggattacaggcgtgagccaccgcgcctggcgaactataatattttaatgccattttttacagtaagtaaaatattaatccatcacataattaaccgttaaaatgtctcatgcccattccctgtctcatttgtaaaaagtggtacttgtattgtcacttctacggcacttatctgtcccacacattttggcaacagattatttttcttctggattcttctctaatagtgttatatttataagcttgtctcttgcacaacagaatgaacttcacaagggcattggcttttcttctatctcttagtgaataattgtcacttaggatttattgaaacacagtaccaaacatgtattaggtaccccactgatatttgttaacttgaataagttgaatatgacaactttgttttgctttgttttattgaatttttcaggattatttgtatgcaataaaatgctcatatctgaagtgtacaatgtgttaactttttgacagccattaactactactcagataaagatatagtatatcttcataattttccaaagttcttttatgtcccttttaggtagtagtctccactgtaccccaggttaccacttttctgactttttatcccttagagtatttttacttggtctagaatttcttataaatagaagcatatagtatatactcttctttgccttcttttgctcaacattttaatattcatacatattattctatctatcagtagtgtgatctttttcaattccagatagtattctacagatgaatatatcacaatttattccattcttttgttgatggacattttggatgttcccagtttgggactactataaataaaacagttatgaatatctgctgcaagtcttgttgtggacatatgcactcatttctataggagtaaaactgctgaatgataggttaagtatatgcacatattcattagaaactgccaagctcttcttcaaagtgattgtcacatttacactgttaccaacaatgcatggaggtttcatttgtgtccacattcccactaacatgcgtattgttattcttttgaccttcacgattcttgtgggtgtatagtgctattgcactgtggtttaacaagagttcttgaggactgttgattgcagatacctaattttaagagaagtatgtgtaaattgtgcatttttcaaacatatttttgtacaaaaagcagcaattactttgtctccctgtgcctttgctattcatggaaaaacgggaatattagtagtactatcttatactgtgaccctgaagagtaaatgagataaatttagcacagtgccagacacatagtaatcactttatataaaatgttaactattattgtgagtaaaggcaatatattgttttttcatcattgttagtattattgagaggcagaatggcatagtatttattgcctgtgttcaaatcctggctttaccacttactaactaatgactttaggcaagttacttaatttccctgtgtctcagtttcctcatctatacaatgggaataatgcagcacctgtttcataagattttgtgatactaaatgagtcaataggtttcttggcacataataaacaagataaatgtgttggctgttattattactaacagggtgctgttattactttatatctttcttacgagtatatctctttaaagtagcaatttatttaaatgttttcattttagcatattgatagaatattaattttaatccagcaatccagtttacctaaatattctccaaaataaaagttgaaactttttttttaagtgtaggcagttctcttggtattgggtttgtgtcaattatctcttgctgtgtcacaaaccccaaaactcagtggcctaaatcattggccactaatttagtgtacaattctggaggtcagcagttttgactgggctctgctgatgtttaccctggtcttgaatgcatggatggtcagctctgtttctagcagttgagttgcttcagttagtggaagcatttgaaccatacatcttatcagccagccagctttccctagcttgttcccatggtggtgaggcaggccaaactgtaaagagcaaagagcagaagcaaggtctctggaggcccagccttagctcttgtgcagtgttgcttccaccatgttttattcctagtgtaaatcataagatttagggacctgagaaacagacaaaacctattgatgtcaggagctgccaagttacattgcaaaggaaaggcagaagagttgtgactttttttttttttttactgaatacctcactcaagagcttgttaagaataggctgtctctggggtaggtgcggtggctcacgcctgtaatcccagcactctgggaggccaaagctggtggatcactcgagctgtgaagtttgagtccagcctggacaacatggcgaaacccagtctctgcaaaagcatacaaaaattgctgggcatggtggcagacacctgtaatccaagctactcgacaggctgagatgggaggatcgcttgagcctgggaggcagatgttgcagtgagccgagatcgtgccactgcaccacagcctgggtgacagtgagacctgtttcaaaaacaacaacaacaacaaaaaagaataggctgtctctaattctttctttttttaattattaatatactttaagttttagggtacatgtgcacaacgtgcaggtttgttacctatgtatacatgtgccatgttggtgtgctgcacccattaactcgtcatttagcattaggtatatctcctaatgctatccctcccctctcccccaaccccacaacagtccccggtgtgtgatgttccccttcctgtgtccacgtgttctcattgttcaattcccacctgtgagtgagaacatgcggtgttcagttttttgtccttgtgatagtttgctgagaatgatggtttccaatttcatccatgtccctacaaaggacatgaactcatcattttttatggctgcatagtattccatggtgtatatgtgccacattttcttaatccagtctatcattgatggacatttggtttggttccaagtctttgctattgtgaatagtgctgcaataaacatacatgggcttgtgtctttatagcagcatgatttgtaatcctttgggtatatacccagtaatgggatggctgggtgaaatggtatttctagttctagatccctgaggaatcgccacactgacttccacaatggttgaactagtttacagtcccaccaacagtgtaaaagtgttcctatttctccacatcctctccagcacctgttgtttcctgacttttgaatgatcgccattgtaactggtgtgagatggtatctcattgtggttttgatttgcatttctctgatatccagtggtgatgagcattttttcatgtgttttttggctgcatgaatgtcttcttttgagaaatgtctgttcatatccttcgcccactttttgatggggttgtttgtttttttcttgtaaatttgttttagtttattctagattctggatattagtcctttgtcagatgagtaggttgcgaaaattttctcccattctataggttgcctgttcactctgatggtggtttcttttactgtgcagaggtctttagtttaattagatcccatttgtcagttttgtcttttgttgccattgcttttggtgttttagacatgaagtccttgcccatgcctatgtcctgaatcgtattgcctaggtttttttctagggtttttatgtttttaggtctaacatgtgagtctttaatccatcttgaattaatttttgaataaggtgtaaggaagggatccagtttcagctttctacatatgactagccagttttcccagcaccatttattaaatagggaatcctttccgcatttcttgtttttatcaggtttgtcaaagatcagatagttgtagatatgcagcattatttctgagggctctgttctgttccattgatctatatctctgttttggtaccagtaccatgctgttctggttactgtagccttgtagtatagtttgaagtcaggtagcgtgatgcctccaactttgttcttttggcttaggattgacttggcgatgcgggctcttttttggttccatatgaactttaaagtagttttttccagttctgtgaagaaagtcattggtagcttgatggggatggcgttgaatctataaattaccttgggcagtatggccattttcatgatattgattcttcctacccatgagcatggaatgttcttccatttgtttgtatctcttttatttcattgagcagtggtttgtagttctccttgaagaggtcctttacatcccttgtaagttggattcctaggtattttattctctttgaagcaatttaattatttcagtggaagttactaaagaacattgaagtttgttagaaaaaaagaggatgtcactgtaatataccataattgacaagtaataactatttgagtactaactggaggagaccaagcttaaatggttattcctgggaagaatgatttgtctcagggtgcgtagatacaaatgttaccaacccaccatgacaaagtttaggcaaatacaaagagcaacactaactttgatattgtatagaacaaaagggcacaagaagaataaaatggtccacagatattgcaggtgacatgtactatatgcaacaggtgtttgtttaggttatgttatcaccctttgctctgaaaaaaaaaaacaacaaaaaactataattccaatgaggtagaaaattggattgtaacagaaaactcacctttcagatgttcttgaaagatcttcaatgtagtattctaaaagttctattgaattattttaaaccatgttatttctattttcttctgaaaagaactaggtgacattaaagaagtctggatagaggaatggaaacaatttcaaaaagtctttcttcaggcctttgatcataggcattattttcaatttggatgaactggggtattctgactacctaagaagtctattgtcaaaatctgaatttattctgcaatataaattcagtttgggtactttaaatgtcaaccgtaatgtctttcaatcagtttattactgagatttttccagatttgatgtgtggtatcaaataacttacattatttgcaactatgagaatgcacagaaagcttcgtaatttacatctaaaaggaatgcaggacagatttggttttagttttattttaaaattttcatcagaaggaaatcatctgtatacatcatactgttgaatatttccaaatgatgttaaacattctgatgctttaacaattacattaaaaattacagaattgatttaagattgtgttaagaggttatgttgttgcttttgaaaacagtgagataagataaatcagattccatctcctcagtgctgcctatgctgacctgcctatataaaatagcaaatcccatacatcgtctgtctgatttcaccctgcccatttaatccccacgcattttagacttataaaatactgtatatttttcttacttgttatttttattttccgtctacctacaaataaatttgagcttcatgcgaccagaggtttttgattgttatgtgttttggtttgcttgtttttgtgtgttttgtttgtttgttttgttttgttttcttttgttttgtctgagacagagtctcactctgtcacccaagctggagtgcagtggcacaatcacagctcactgcagcctccacctccttgggctcaagcagtcctcccatctcagcctcctgagtagctgggaccagaggcacatgccaccacacctggctaattcttataggttttgctagagacagggtttcactatgttgcccaggctagtgtcgaactcctgagctctagcatcctgcctgccttggcctcccaaagggttgggttttcaggtgtgagccagcgtgcctggtcatctgttatgttaagtgaagaatacttagcagctggaagagtgcttggcacaaagtgaacactaggtagatgttggttgaatgaacaattaggttgataaatgaaggcatttaattaagaatgtaattagtagcaaatcacctttaaaaatatatctcattttatgtttaaaaataattacaaatgtataattttaacctcctcctttaaggttcttgtcgtcttgtcagtcgaattaaaatctagccttaacttttttcttgaaatttaacaggcttattttcacacctggcttttgttcttgtagttgtaattagtcagaattagtatattaatttttaaacacacactacctcatcttttgctctacttatcaaattatctaattaaaccttgaattttcagaaaatagtttcccaattgcattctgtgtatatcaaaatgcccttgaaaaaaatggaatttgaaaatttctttcttctgtcccccgactcttgcctctttcttagtctctccgtccatatatctctccttttctctcatacaatttaatagagaatgaatttccatctttggtacattcatattaaaaatctaatgccacatatgtggaggaaaaatcatatagctacatttcaaccaaaaaagtattgtgtatgaaatatatattctatagtttacttagtgaatgttattcctgaagactacaagtggcagcaaagaaattacgtggcatatatgtgtagattaagcatggaatgagtattgttttaaaattaacctattacctgtatggccatgatagtttttgtgaggagtaaattaatgcatatatgggagaaggctttgtaacatgtgaaacacttggtatatgagaatttgtattgaaatgattagacattaaagcatcttgttcataaaattttgataatcttcttttagccatttcttcaaagtcacttctatttttgtcaaatttcacctgtcggggggtttttagcttctgacctcagtattgtttcagtggctgagattaaacagcattctgacttgtacacagacaagtaactgtgctaatatccagtgaaattgaaaatggacaggaaatctttatacagctaaggaacaaataaatgataagagaattaatccagcattattgttcagaaaattaaacacttgagcagattaacaaaacacattataaaatttggattatttgtgaagagttgcaacatttggggaatgtttttattaaatgaatcttttattttactggatgctaatgaaaacaaactcattattttttatttggggtacgagtgttttttggtgacatggatgaattatatagttgtgaattttgagattgtagtggacccgtcacccgagtagtgtacgttgtacctaatatgtaattttctatcccatacccccaccctctttcttctgaatcttcaaagtccattatatcacactgtctgcctctcaagctcatattattgaagacttttccctataattttatattatttttatgccataatctgatgcttaatttctattttatttattaagtatgtttattttagggttaacattcataatgatcataaaaatcaggtaagctacagtagatgtagaaatttaacgtgtgtacacaacagaatatttcatgaaatttgtgtttaaaaacttgatttacatgattaaatcatttatgtagttttgaaatcagtgttatattctcctcaaaataaattgcatggaagttttaataggaatctcccacatacagtataattatttatctaaaacataatagtaaatatgtttataaattttactcaagtttaaatataaatagcgtttaccgcattaaaatatgaatttatcttattttattacatcaaattgtttgtcagggtcatattttatttagcgttccactaatgactacttgaaataaatcagagaaggtaagtcccataacagcttatgatctaggtcagtctcttcagatgaagataatgaagtgatttgaaaaactgactctattactgaatagtggtatgcttacttgagatagattatttatagcccctgcaaacaagagcagagttattttatattactgagacattttgaacaagaatgttagacagagtgaattgaataacttttcttaggatttagctcattttctatcatttcacatgtgttgacttttaaaaatctatttttaattatttcaactggcaatttaataaatacatttgcataatgtcctgaaagttcagggtagatttgtatgtgtaacgttctcaaaatagaggggagaattgttgggaaagctttgcatgttttatcttaagcaatactttttccttaaaaccaaagacattgaaaattacagccacaggtggatgtttgttttgagctaaaatagttaacagtctcatttatgagtccttgctctttccatttagccccatcaaaagggatgagtttatttacacagtgaccgtcttttttttttttttttttttttttttttttgagatggagtcttgctctgtctccaggctggagtgcagtggcacagtctcggctcactgcaacctctgcctcccgggttcaagcgatttccctgcctcagcctctcgagtagctgggatcacaggcgcgcgccaccatgccatctaattttttgtattttcgtagagatggggtttcaccatgttggccaggatggtctccatcaacagaccttgtgatccacccacctcggcctcccaaagtgctgggattacaggtgtgagccaccgtgcctggccgatccttctttatttttaataaaatctttaatcagagaaacctggaaaatagcatgaaggcgtgtccatttggtggcttccagataggaacttgatttacctgcaggaagtgacagcttagtaaatgatccttttgaaaatattgctgttattactctttaaatccggatttgtattaagccatccttgctatgtccttgatccttctttgaatccattgcagactgaaatatctcaatccgccagatgttctggtactgaacaatagctgtacaataataatgatacaatctcaaacacatcacagatgcactgttagtatccattactgtagaagaaaaaactttgttagcacacgctaattacttctgtgatggggaggaaaacaaaaatccatattaatttatatctttatggtctgcattatatttcttcatgaataatctatcttaaccatttattaaactatgaatacatttttataaatctggttgacatttaggtattttattaaacacaataaatgccagaggaaattgaattaagaaagcttgtaatacgctttactactagttaaaaaaaatttgtagctgtaaatggttctgctctatatcaagaataaatctgttcccagaccacagaattcttgttctttttcataccagaggccctgatcttttttgttgatagctggtttttaacagcttcaccatatgttttattccttttgatttgtaagaaatttgattatcagccttgaacagaaatcataatcacagcaaaaggaggcaagtaacttggggaataatacagagtcatttgaacagcagtgtgaagtctgagtttaactgactcagatgcccactctagtagagcactcatcagacttcagaccgaatccacttcggacagagaagtctccataaggtattcagactggcttcccctgtctttaaaacaaataaataaactctacttaatataataataactgaatttaagtatttccacagattagcaatttacgtgagagaaatcagcaataacatcaagcatatagcctgaaagtctgaaattgatgagagggatacaattggagccactagttattaatcatacgtgtgtatgtgcatgtgcacgtgtgtgtgtgtttgtgtacaattctgtctaaattggaactgatcttaaacccatttatatttttttgtggcagaaattttatgaggtaggcagggtgaaggaaggcactattaactttgactttataaaacttagaattgggctgggcacagtggctcatgcctgtaatcccagcactaagggaggctgaggcgggtggttcatgaggtcaggaatttgagaccagcctggccaacatggggaaaccatgtctccactaaaaatacaaaacttagccggcatggtggtgcacacctgtaatctcagctactgaggaggctgaggcaggagaatcacttgaacccaggaggtggagtttacagtgagctgagatcgtgccactgcactccagcctgggtgacagagcgagactccatctcaaaaaacaaacaaacagacatcttagaattgtttggctctacgttggttatgtaatttgaaacaaatatatgttgtgggataatcttaacgtgagctaactggtatatattaactaaagtcgttgaaatatttaattttgaaatgcaataatattttctcaaattaatgctcccgcctgaaaatctgtgagccagatagtaataattaacttctacctctacctaggattcctccacctccaactattttatcattggaaatgcatgaaggacaaacaactcaccatttctgcccactttagatgctaaggtgatattgatcactttgtcccatgtggaagaacatctaatgatatgttgggatgtctcatccataagtttattagtcaatcttatgttttatttgtacctagcaatgccaagcacactgtatgtgcttcattaatacttgtgaataaatatgtgaatgaaatttcaaaaaccatgaggtgcccttttgtggattcaatatgttttgtataatggtggagccaccctggaagaagctgctttgtttacccataacagcttatatttattgtgtgagacattgtccttcacagtttacatatataatgatgatatagtcttcaagagtatgaagtatagatactgttaacatctgttttcagataaggtgctggcacttagaaaagttaggtaacttttcaatcattccagatttcctaagacatagagccatggcgtaaatctgtgcacttgttttaaaataatacagctttattgagatgaaatttatataccatatagtttacttttttaaagtgtacaatttagtatattcagagtgaataataattataatactaattcatcattacaatcaattttagaatgtttttatcacccctgccccccaaaattgcttccactcgtttcccctattcactccccaacccagctctggacaaccactaatccactttctgtcccgacatttcattaaatggaagcaggcgatatgtggttctttatgactgacttatttcacttagtctattggtttttaaggttcaccaggttatagcatgtatcaatttctttttattgcagaaaaatattacattgtatggatataccacattttatttatttattcattagatgatggatattaatcaatgctcatttgaccacagctgtctgttatctgtctttctcatgactttggattaaattactactatagcaggtctctcataccttgcaatttcagcagctccgttgttcagcgctgctagttctctttcagcactaccgcagaggacagctccaagtttatggtttctgagtcccacaggcgcctctgattctgcctagctgagatcctcagagaggtataataaagcaagcaaatctgggtaggagcacagcgactttccctctgtctgcaggtatttagagctgattgtatcctcagaatactgtgtaaacggtatattttgtgtcacaatagattatcacctttggatttttcattttcaataggaattagattatggcatctttggttgagtgttatttagatttcctgtaaatctaggttacatataagtaggtaagatgcacagtgaaattcagtccatctatcttttgatgggttattcgaagtagtagtattaaggatcatttggtgaaattacttgttcattacattgtaatgggaagttagaagccaatatgtaagtagataatttcttttacaatatattttcttttcaagtttagatttatatgcttattaactttatccttcatatcaaattaaatttgttattgaatgccttatgtaataatcatgtagcttagttacaatgctcaatcttctgtcataaggtatatttgtatacttaagaatgaaattaattacacgttataaacatcacagtggaaaatattagttggattattaatctacaccatttacattctatgaaacatatttagggccagattctattagtacttttaaaaattttacatgatccttgacattgattatgattaaagacagaccaaagggaggaaaggggtgttatatcacttatgaggaagacacttaacatcttttcgcttgagttcacaacataatttagatgaaacactgttggccttggtaattaggaaaataataaaggcgaggagttggctttatcacattgtgtgaactgacccaacaataatgtgtcagaaatacagcatattcccagtttgtttgctcaacagaagcagataaacagaaggagctttctctaagccacatacattacaatggagacataaattacaatggagctttttccattgtaatttatgtctccattgtaatgtatgtggcttgggaccattgtctttgtaataatctggtaagattgtatcttttgaaaacatcaaatgtgttattttttcaaagtgatttggccaacggggaaattatgcagttatttatttatttattcataagccactaataagggcaaaactgagattctaaaatgattagaataataataagggtgttaaaaagtgatttttcacttcctatggcaagcagaattcacttataggtccatttccctggtgctgctatgacctttatattcattttatgctcagagctatcaattgttttcaaatgttgacacttgaaaaatcgctgtatgaatgatcatgtagttcccacagttattggtgctagaaatttctgattctactctggcctgggcagctgtcagcctagcatggcagtaagtagctttcttacctattagagaatgccctcagttcaaagaaaggagacatatgtgacaactgagagggttaattgttcctataaatgaattcattgaaaagtatttcacagcacacttgtttcaggcaagtctctgagaattattttatttattgtttttttggttgatcatgaccttttattgtgtttatttgcttaatattctgaatcaacctattgctgaatttctaagtaatgtactttattagttgctaaatttaacttatcctttcttatataccaatgatatagtttccaaatcttagattcttcttgaatagtactttctctttatgttgaccaattcatatactatactttgatgaaattatttttgtgaatcttctttttttctaaatgagatattcatgtatgataaacataacctttttaaagtacgcaagtcagtggtttgtagtatattctcagattgtgcagccattatcattattaaattccataatattttcaaaaccaaaggaaacccaggacccattagcagccactccatatttacctgtccatcaactcctaacaaccaccaatgtacaatctgcctgtatagatttgcctgttcaagaagtgtaacacaaatagagtaacattatatgtagagttttgtgtctgacttctttcagttagcatgacgttttaaaattaatccatgttatagcatgtatcagtacttcacttatttttatggctgagttatatttgattctatggatatacaacattttgtttattcattcatcatttgatggactttggggttgtttttattttttgtaattataaataatgttgctttgaatattgtgtacaaggttttgtgtggaatatgcttttattttgcttagatgtcctaggagtggaattgctgggtcatatggtaaagctatgatgaactttttgaagagtgataaatgaaactgtttaccaaagtgtttgcatcattttacattctcagcaacaatgcatgagggtttttatttcttcccattcttgtcagctctatatgttgctagatttgtggttgcttgttttttaactatagtcatctaagtgaatggaaagtgtttctcattgtggatttgatttgcatgtctctaattgctaatgatttgagcatctttcatgtacttgttggacagttgtgtatcatctttggataaatgtctgttcaaatttttgtctattttttaactgggtcttttttcaatatttaattataagagttcttgatatattctggatatattttggctatgtagtctaagtcgtcagacattgttttttttcaggatgtttcagttacttggagcgtcttgaatttccatatgaatataaggaccatctttataatttctgcaatacaacaaccttaaacttttacaaggattacatagaatctgtaaatcaatttggaggtattgcaatcttaacactagtaaatattccattccatgaacacgggatgtcttcccatttatttaggtctttttaaaatttctttcaatgatgttgtctagttttcagtgtacacatctttaatatactgattttattaaatttgttcctaagtattttattatttttgatattttaaatgaaatttttttatttcatgtttgaattgctcattgctagtgtatagaaataaaacttatatttatatattgaacttgtatcctagaattttgcttgaacttgtttattaaatctaaaattttctgtggattccataggattttctatgtagaagaaattgagatagttttgttcattccttccaatctaggcacattttattttattttatttttcctaattgtcctagttaggacctccactacaattgaattgaaatagcaaggccgggcgcagtggctcacgcctgtaatcccagcactttgggaggctgaggcgggcagaccacaaggtcaggagatgaagaccatcctggctaacacggtgaaaccccgtctctactaaaaatacaaaaatgtagccgggcgtggtggcgggcgcctgtagtcccagctactggggaggctggggcaggagaatggcgtgaacccgggaggcggagcttgcagtgggccgagattgtgccactgcactctagcctgggcgacagagcaagactccatctcaaaaaaaaaaaaaaaaatagcaagacaaccattcttgtcttctttttgatctcacgggaaaagctttcatcttttactgataagtatgatgttagctgtgagatgcccatttctgcaggtgcccttttttaggtttaggatcttccttccaaggattttcctttctagttccttgagtgtttttttatcatggaagagtgttgcattttttaaatactttttatgcatgtatcaaatgatcatgtggcttttgttctttattgtattaatatggtgtgctacattgattgatttttatatgttgaattaatcttgctttacttgaataatctggtctatatcattgctttacttgaataatctgttgtggtcataattctttttatctgttgctagatttggtttcttgaaaatttttgtgtctatcttcataaggagtattaatttgtagctttcttatgatgttcttgtctggtttgggtatcatggtaataatgggcttatgtaatgagcctggaagtgtttctttgtcttctagtttttgaagaatttcaataaacattttgtggaatgtaccggtgaagccttctgctcatggacttttttatgagaagtttcttgattactaatttatttactttccttgacacagggttattcagattttctgtttcttcttgaataaatttcagtagtttttgtctttctaggaatttttctatttttgtctaaattatctaatttgttgataacgtagtggtttatagtaattgccttataatcctttttattaaaatatctgtaaattctgttgttatccccccttttattctcaattttaggattttgaattttctcaattgttttgtcagtctagctaaagttgtgtcaattttatttacattttctaagacccaatttttgttccattgatttttttctgttgttttttgtttgcaattccctttatattttactccagtctttattattttctcccttctgttgctcttcttttccagggtttcaaggtggaaagttaagttattgattttaaatttttattctttttaaatatacgcattcaaagctttacattttctttgaagcacagctttagcttcatcttttaagttttggcatattctgttatcattttcatgcatctcaaagtctgaaagtaatttcccttttgatttttttcttgaccccttggttatttatggataagttatttattttccacatatttacaaatttcccaaatttgcttttagttttgattgctaatttaattttattgtggtcagagaacgttttatgattttattccttttaaactcattgaagtttgttgtatcattttttatattatttataaaaccgttaatatttcaatatctctaaaatgtaggaaaaatgtatataaaatatagtctgtagatcttttacagtctaagttgaaaaatgttttcaatgcacttaagaagaatgtgtattctactgtttggagtggagtgttctatacctgtttgctggtctagtttgtttatggtgttaaatcttctggatcctttttgatcttctgtctgattttctttccactatttaaagaaggattttgaagcttttcaactattattgttgaattttctatttcttctttcatttctatcagtttcccttcctctattttgagtctttgttttttaggtgcgtgtaagtttataggtattattttttactggcagattgacccttttctcattataaaatctgttcatctgtactaaaatttttggcttaaagtattgaagtgtgatattagtaatgctgttccagctctttttttggttactgtttgcatatgtccttttctgtcttttaactttcagcctgtttttgtctttgaacctaaaatatttcagttgtagacaatatatagttagatcatgtgttttttaaaagccagtgtataaatatctaccttttaattacagcgcttaatatatttatatttgctataattacaaagtaatattgatgcctgtgtttcctacttgttttttatatgacttatttctttttgtttgcgactcttgtttcttccccatttccatcaacatccctgcagtccaggccttcacatggcagggaaatgacagatgtattataccctgtttaggtaattgttgccatttcagaatggagtcccagtgatgcttggtcttttaatatatgagtggaaatcagaatttttaagtttttggaacacttcaatattttaatgttgacaactaatagagtttttaaaaaatacattagacatagtttgtggaacaagcaagttatgtctaatgagcacatggaatcaaagagaaaccatttgccacctctgttttccacatgtggaaagtctcaggaccagctcaattctggcatgcttgctttcatatatgttgtttactgatacttacataaatatttcctatctgtaaaatagtgggaaatagaaatagtaaaagcttacttgtattaaatactttatggtatgctggtgatgtttatgtccctacctctttttatatcaacttattttagttttcaggtggaatatgttcaaattttatcagactccaatcaaatactgcagtagtttctaagtcttagagctgttggtaccagatggatggatggatgaatttgtgttctcatgattgagacattacgataaggggaaagagtattacagcaacagacaaatgacttggctttagccctcaactaatttattgggtgcttttcaagtttcctactcttataaacttcagttttctcttctataaaatgaaaagattagccttgatcatttttaaagtcccccaggctaacattggctatgactgacactgtggagctatgggatctgcatgagaaatttttctcagtcagtacagcatgcacaagggagaatggctttattttatgtcacaatgcagaatgtctgttgtttgctatccctaaaagtgatgtcctctatgatttacaaagcctatggagacatttgcagcataagggaccgccttcccactttttcacctcagcacatgctacctcatcacactttctccttatttttagttttatgccatcatctgcaggtaatgtttgacctaaaacctacaccattacttgttcccttttaaaaatggcttcacttgtaccccaatggcatatcgagcacctgtgagacttcaggtgttgtttgatagtttaactaaaattaccatgattatctgtgtatatgaaaggcttttaaccctccactacctaaaactcactcgttctgtgctctcacttgttttctattataatacagaaataaaaggattgcatttgaatactgaaaaattgtcttactgccagtgcttgagtgcacaaatccggttaactctcaaatgatagctattcaacctgtctttcaaagcagtagatgtgttttgaaaatttcacatttgatttataaacaaaaagactcccttgactttatcctcctgttttccagacttttttattttttaagaatgaaaaataacagctaaggaatgtggcctggaatgaaaatatccgaatcagaagcaaacagaataaaaacacacctacctttccccctgaaataacattaatgtcttattggatctgacaaaattcaatgaatttctaattaaagactgtttccccactcctgattcaacctgtcctgcctagcagtagtagcaagaatgagtcatagtctcttcagaaagtaaagcattgcagattgagttaatgatgaatttttcccccttgatttgaaatactcttgcctctgtctttccgtcaaccctagaatagtaccttgatttgtaattttatattgattttaatttgcttcattatttttcttgtagccattaaaaatatatcaaacagaatcatacttgacaagaagcataaagaaaccttccactgatactggaactgttgggttttctttctactgaagcttttaatgattctttgccaatctactttttaatcatctgaagtaaaagtagtataaagcgtgttacttgaagcattcttgacagagaatgcagctgtgcacctgtgagaacaaataactgatgttccttttggtcactcagcaggaatagcattttaataggtttcttcactgatccggcatgctaagagtagtttgtagtgtgcatttaatctactgtctgtataggtagctcattatgtcaaggaaaggcttatgcacatttataatactttgtaaactgtatgattagatcattatttagaaaattgcttgtatgggaaatggttgaatagaaacatgttttccaagcaattacgtttccttcttaaaactctttgtccttcatttaaagataaacagaacttcttaggtaacccttagatattttcctgagttatagagttttggaggattcttaaggatgtgtatctgacatattgtaagcacgtaataaatatttattaaatggatgaatgaaactaattaagaaaaaagtgagagtttttttttgatacgataaaacttttttttaagataaaaatggcactttgggaggttaaggcggcaggatcactgagcccaggagttcaagatcagcctgagtaacatagtgggaccttgtctctacaaaaaataaattagccaggtatagtggtgcacacctcgtgaggccaaacatattgctatgaccagtggaataccagtggaaagaacatgaatcacaacaggatggcaggttttaaaaccagttgctaggtctccttttattaatgttgtggagatttcagaaatgtttattaatattaaatagttttcatcctcctgaataattagggcaatcaaacactgccaaccaacatttgacatacagcataaaagtcaagtaaattgcatttatttttgctgttaatattggactatcactaagcaaatcttgctggtgtaaacttcttagtcattggccagtttgttacaaagatctatgaaaaattcttatcccagtgagccaggagaaacttctcccaggagatcctgaaatctaaagtaggaacacatgcctctctatgtgacatccattgtgacacagatggtttggtcctttccaataataaaaaaaatggtgcgttttggaatacttgtgctttttgaaactataaatcacattatgagtataaagaacacagcttttgaaaaaaataaacttttttttccaaatgttggagaaaccagtgtttccagttgattgacctaagatgggtgttttaggcccttttggatttttaaactgtttttacgtgtatgtttctgtgtgtttgtgtggtggcttgtatttatggatgtgtgctgttcgttgctatgataggaaataacattgaaaactggagttatatgttattaagaacataacaaaaataaaaacactgtgtgaaaatctgtgagttaggatcaaaaattttatcttcaggcaaatatatatagccttaaaaaagttatcacatgacatattgtaaataaaatgaagtaatgttcaacttgaaaagttagaaaagacaataaaactattggagtaagtaaaataattaaaagatgattaaataatgatcaagaaatagaaacaaaaaatagaaaacaacagaaaatagattagatagatccaagaactattacttaaaagcaagacgtacataaactgtttaaacgtcttgtacagaaaaacaaaaatatagtcattataagaaggggttatatcaatactgaagggattaaaaatattaaggaaaatggataatatttttatcaatgcaaattatataaattaactcatgtttaaaaacattaataaacaagataacctaggaaaagaaaccctgaaaagttgtcatttttacctccaaaaaaatgcagtgtgctgtcatcttaatggataaaccactttaaattattaacagataagcaattttatggtaaaaaaattgattcagaaatagaggaaaaactgaaaagtgtcctttaccaagcagcataattttaaacacctgaaacagaatctgacgctcagaataaatatcagggccggaggtggggtggtgattctgaaacccctgttagccattagccatgctcatacagtcactcccaactatatgtttgatatactttcttaaccattcctgactgaaaaacactatagagtaacaaaaataattagtagtgtagtaatagattgatactttatatgacgcaaacctaagacaatatagtacttaaggagaaagcatttcaggcatacccaccaaataccccccaaaataaaggatgcttcccttatactttgtttaacttagtgattcttaaagtttttctgtctagtaagagatgaaaaaggaataactgtaaaattggaaaagcatataaagttatttctgcctataagaaatatgattatgcccttatttatacctatgaatctgaaaactttaaactaaaaatacatgttttataacaccttttaaaatgtactgtttttatttaatttcagttttcttgtcaaaaacaaacaagagtgtacaattaaaattgataacaacaaagtataaaattcatatgaattgacttaacaagagatgtccaattcttatgtgacagaagccataataatttgccaaagaacatgaagtttcaataaaatgggaaggttaaatatgatacagaatttagtttcatgcacacacatacatatgtatatatattagaattctaaaattatcctgaagtacaactggaggaataatattcaagggtagccaagggagtttcgaaaataactaaaaaaattttttaatgaaatgtttatataatattagatggattagacaaatgaaaaggtcaagaaactgacctacatacatattagaagtgaatttctgttgaggttggcatttcggtgaagctgtataaatgtggattatatgagcatgatgtgataataggtgaaagggtagggcaaatcattatctccctgtatatcagatgaaactcagatttattaaggaataaatgttaaatatataattacaacagaatccaaacaaacaaggtaactatatgatttggggataaggtgagcctttctttaaaaaaaaggataaaatgagatatctatcgatttaatactgtagtaatttgatacaaatgtaaaagaaatacaattacaattattaacaaaatgagaaaaaatttgcaaatcttaaacggaaaaaaattgcgatatctctaaatctaataagcaaatgacatatcaattaagcagcaaaatatgaacaatcaattttgaagaataagaaatacagagagcttcttaacagcttcagtgttaatcaatgaactgttcatttaagttattatatcatgtttcaggtatcaaattggtaaacaggaaaaagaaaaattaatgcccactgtttcagaggttttcaataaacatgttattttatatttcctaagagtttttaatttaaataataaaatccactgaaatgtacatcaaaaagaaacatgcatacaaaaacaaaaggagctttattggaaatgtataggacagttcacagaattaaaagaattagctatgaacagctatgtagaaggaatttgaaagttagtcaatatcattgagcataaatcagctccattttttttttgcacgctataataagtaacttctcttgaaatgagaatttctagtagagaaagtgaccaattgatttaacttaggtaatttttgccacttgtatgaattaaggtgaaaactttagacgggctgtcttgttgacactcatccaacatgtattcatcagtttcccaaacgagaagtgggatgctgttatctgaagtaaagagaggcacttggtaggcgaaaacagtggatatccagcttggttattaataaggatgttaacagtattattttttttaatggtgggcttacgagatttctatttttctatttatgctttttgcttttttctatttttttcctcagaaataagactgttataatcagaagtaaaaaggttactgaaatatgtaactggagaatatgttgagacaccctgaactggcccatttttagccaattcatttttttaatgtgctagataaatttatgcgtcctagaatcagaaggctttgaatcaatcaagttctggttttaccagtaatgaacattagtaagacatttaactagtgttgagtcttggagctattaactagaaattatgaattatgttactatctatataaaacttttaaaaatttggcttaaaaaattacatccacatgtttaatatatttataaggcagaattccttgaacatatatatgacctttgatgaatgtttgttgaatattttcagagtttcttaatgccaatcccaaatatcacttagtcaaaaacttatttatcttgagacttctaacttctggtattatttggttatattgttaccgtttcttcactgaaaaaaatgtcacctcccaaatgtctcatccttgtgttttatttgattttgaagatgtgggtcatcttttatgatgaacacaggttctatttttatatcataatctcatgatgattatggtgaaatgaacaaattaataaatggaaataacagtagaatatttggtggattgttaatagatattaagtactctagcagatagagtcttttattttatttgatctctatatattaattcatctgtctgacaataaaatgtgtttttaaagacatgctttatcaagatgtatttgaggcatttccccccactgatctattgtacttaaaaatttttgaaagctcaaattacactaaatgactgcagaaaaagtcccaaatagtaagttgccaatttgaaacttttattagtctcaattagttaatttattgaactaatttaaatagatcaataaattaaggtttataaagaatattcgggcagtctttttcttaagagaatcctgcaagactgaggcataagatacagtctgttgatgtttttatccctttcatttatccaaacagtgtaaaacattgcttatcacattggtatgacttacaggattcaacagaacacttagtcttttgtcttcattttccccattgctttgtatttctttagatttaagttataattaacttgaatattaatcttagatggcatgatttgatatgttaaaacgaagagtttaagacgccgagctctgtggttctcgccttagtaatgtacacattacagttgccagttgacaggtttcatttatccatggttttctttaaaatgcctattgatgcaaacctttttaataagtaactcaaaaggaaaaacacacaccaattaagttgacagtgatcccatatatttcttcctctaatttcccttttgtgacttcattttccttcccccatgccttcctttctttctacatacatgcacactatcaccattctagtggcccctgcctttaggcaccatgtttaagctctcagacctctcttaaatacttgtaacactatcaatactacctattttgttagcataattgtatggactacatggcaaatatttctgaagcacactgtaaatgtctgtataaatgcaaggattagcgttgcccgctgaatctagacctgatggattatcataaagaagacaagtttgcatatctgaattcaattaacagtggtacttgtttgtgatggagttggggtttcatttaactcaatctcattaatttatgcaaggaccaaatttgtttagtgtagtttatttgttagaagaagctagcgggcagaggattcatcaaaataataaccaaaacactcagaaaaatcaatagctacttttcaactcctgatctttgtcctcacccagagtgagttctaagcaaaattgtgcaggttatcattcctggatttcgcgctccctctcacacacaaatcctgaagagcattatcatacccattggttcgttgtgcagtggatcaccgaggcatttctttatgtgtactctttggcctaccattccgttctaatggacagtcatagttcatagtgagtttgaagtctttcttctagttaatctgtcaatttttctcacacagtgcagctgctgtgaaagaaattggagctgttacactttgtgctttggtacagtttgtaaaatgctaggtaggagacaggaaaccaaacacagcatgctactaatttctttaaaacgactgatgtgctagaactcagagtctgtgtcccagagagctggcatccctttttttctgagaagactaacgtcgtttgaaagtgttatcttacttttgcatcaacgatatagatgcctttggtatgacttacaggattcaacagaacacttagtcttttgtctgcattttccccattgctttgtatttctttagatttaagttataattaacttgaatattaatcttagatggcatgatttgatatgttaaaacgaagagtttaagacgccgagctctgtggttctcgcctgtagttccagctacttggaaggctgaggcagcaggactgcttgggcccatgatattgaggccacagtgtgtgatgattgcaactgtgaataacttctctagcctgggcagggtaacgagaacttgtccctaaaaaaaaaaaaaaaaagagtatgtgtatattgatatgtaatcatgtgactagacccttcactgtatactatataggaaaagatatataatatgctagaaaaacacactataagaactgttcttaccagaaagtaagcttattccagaagaggttggccctgtctccatcaggaattgtcagaattacagggatatagcaaagtgttctttttgacacatcaggattcctttctcttgaatgaaatgactatattcttcttcattgaagcatttgtataattaatcaagatgtttgtatattactctcctcctaacatgtgagagctgcaggtattttaaatgagaatgcttcaggatgtgtagtactgtctctgtgtgcagatttactttttattttatacgtctggtttttttgtgtgtatgcatgtgtgttgtgttgtgtgttttcagacagggtctcccactgtcacccaggccagagtgcagtggagctcactccaccctccacctcctgggctcaagggatcctcctgcctcctcctcccaagtatctgggactgcatgtgcatgccactatgcctggctattattattattttttaatgtagagataaagtcttgctatgttgccaaggtttgtcttgaatgtctaagctcaagcagtcctccccacttggccgcccaagttggggataaccccacttgggataatccccaaaacgcccaaggttttgggattatagatgtgagtcactgcacctagctgtttattttacggaggggccagttaactaattccctcttctaataaaattgttttgtaaatccaaatttgttcttgcctgttactactatttagaattttgcaattttattatacctagtcaaaagaaggaaggacgattcaaaaggaagaggaaagaaaattaatattaatcaatatatatcaaatgcatactaggcttttagcatcatctcaaatattttatatatattatttaacattcacaagtaccacataagataaatattacagttatgattttacacatctgtaatatccagagatattcaagaatcatagccagtaagttggatgaacattgcctaaaaaacacatttttaaaatctgaaagccagaacacttaacccttgaacaacgttagctgcatgaatccactaatacccacattttttaaaataaaagttacaccaagggtgcctgcctttcctgcctcgccttccatctctttcacctctgtcaccccagagacagcagaactaatccctcctcttcctcatcctcttcagcctactcaacttgaagatgatgagggtgaagacctttgtgatgatccacttccacctaatgaaaagtaaatgtttcctctttcttatgattttcttaataacatttctttagcttactttactgtaagaataatgcatataagatacaaaatatgtgttgactgtttatgttatcggtaagacttttggtgaatagttggctattaaagttttggaacagtcaaaattaaacaccgatttttgacttcatgggggttggtacccctaccctcctcgttgttcaaggggcaactgtatattctttttggtgtatatagagaccctgtaaaagagaattaaactttttcaagtccctcatttgtaatagtaatacatgtatagcctttaacaattttaaagcgtgctcttaaagaacattttctttgcccatcataataaatgcttatattaggcattattacctccgttttacttgttaaaaatcctggacttctacaatctgtcagagttggagaatcaaaggagaaagtgccttagcaaagagaatatagctgaaacaagaatcaatcaggctgttggggatataattctggaatgaaaattagactgaatttgttcttaagcatctttgttgtttgagctctttgttttctcatgtttagaatgagaagtggggggatttaattacgtttagtgacctttcaagctctaaaatgttttgctacttgaaagtgtacttagatgtgttaatgttatatacagaaagaaactgactgaagctacttaataaaaagtaatcaagatgaattataacagaaatagtaatataagataggaaatcctgaactaatattaggttatgtgcctaaatttgtgatttttatttaaacctggccttaatatttggcttcatttacctttcccttttaacctcagcgtcccaccttaacatagaatcaatctatgctatttgctatgtatcccaggtggataactgttcttgtagttgaccttcataatgtaactttattggtatagttaaggttaatggcacattaattttctataagacatcagtcagtatcccattttaatttaccattttcatgatgactgctgttctaagttgtttgtgtcatttttggctgccataaattatcccgaagcaaatatcaatgtgaactcagaaccatgcatgctgatgacttctgaaattattaatgccagtacataggaaaaagaaatacatgagtgcacatttggttgataatttctttatagattaccattaacctctttctttaagggaacagcataagtacatctgtgtttatttgctctaagggaaacaacagttataattaggaataattataacagcagcagtgaaactctaaaaaatatcctggaattactatcattcctaaaatatttttatttcagtggaaacagccaccattaggatctcatgggagagttcaaagagaaatgatagattatttcagatagacccttgttgggtggctgaattctcagagtggaaatagcagataatttgggctctgttcaaagcagtctgaagaagctctgtcctatagctctgaagggacccattttaattcacagagcacattaattgttatcccccttataaacatgtctttgtttgaagcattatctcaattgtgaaatgtggcttagaacaattctagatagtatagtggtaaaaaacttcaactcaggagtcacatagatatgggttcaaatctcatctccaccatttattagccatgtacccccatgaaaattattttaaacttttagtttccttagctttaaatggaaataataaggctgtccccacagaactgtcctgagggttaaagaatctttccagagtgacctgtacttagtaaatagctcccaaaattgtggaattctgtagctgtttaaatgagaagagatttttattaagaggtttccaaatttgtcctctttagcatgccattattgtcactttcaatcacttgggttttcagtactattattttattattttttcttcatatcagctttaaatttattctcttttcatacttagtcttgtcaaagccagattgtctcggaggtcttgatgttagacgacctagtatctcaggtttctctttgtaaaacaattgaattaatacatggatgtggttaggaaagtcatttgtggtcacataaacttcagaatcctttatgtccagttcttctctgtcacttgggtattcctgttataagagagaaaggagtcatatttagtgacatgatttgaccttcatttttacttaacctttggtaagtaacagtgagctgcttcaaaatatagtagtatttgtgtattaaaaacccacattcatgatccttaatataaaccaggcactgtgggaaaccacaaacagaggaaagaacattaccaacacctgtagttatttattttatgtgctttggaaaataagttaaatgccctcaggagcagtgttcatacatgaaaaaattctctacttatgccacaaggtcacataggattgtctgtatgataaagtatacattagattactctatctattttgtaacactttatagctgtaaggttgtatttttaaacgagcaaaaatgaatcaaaatttaatttgaaagcagggactcaaacagatacttctgtatcaatgttcacagcagcattacttaaaatagccaaaaggtagaaacaacccacatgtccatcaatgtgtgaatggataaacaaaacatggtgtaaacataggacggaattttattcagccttaaagaggaatgaaattctgatacttgctacaacatggacgcaccttgaaaacactaactgactgaaataagcaagacacaaaaggatgaataactatatcaaatatcacatgtaaggcacccagagtagttaaattcagcaagacagaaggcataatagtggttagcaggggctggggagttatttttttaatgggtacagattttctattggggatcatgtaaaagtgttggaaatggataatggcaatggtgacacaatcttgtgaatgtacttaatgccactgaattgtacacttaaaagtggctaaaatgcagactttacattatgttagctctccacaataaaatgtatactgaattttaaaaagtgaacagaaacttagaaactaaaatactaagcatctaattatctgaaatatgctgttaagtgtctttttcttttattgagcaactagctgtgtgtatttaatattctaagatctttaaaatagaggaaaagttgctcttttcctatttaacattctaagatctttaaaatagaggaaaagttgctgtctcagattggtggatttcacattgatggaatactggaggattaccgaagttcactttcctgggggctctagttcatgtctgactcctgtcatataggcccaaaattgccatctcagctacacagagcctcagcttgataagcaaaggtatttttcttgcaagagctctcttgcctctggagagactgatctggaatgactgtcaataacaacaaccatatacctgaagaatcggtctcttccattttaatttcatagacatgcaccgctggaactatgattattacaggatgaagtctcctataggaaagccggctgagctaacaaaatcaagccccattagtctgtccctggagcacaaactctaaatggccaggggagggaaagtcacacaggagagggcaagtgattggaaattgtagaaaatgggagaacgttgttgcgtgccatggtctcatggagattcatggaacctggtaaattaaagtgcacatccgtcccttaaattgtcatgctgcttcaagtttacttaacttttgtacagacttttacagacttttagaagtatttgtacagacttttagaagtctctccttcttccattgcttgtagctcttagatttaaatgatcacctgttcttttttgtagtcaagttgggatgtgcccccaaacacgtaacatgttttgaaactaaacaaatatccaccattaaattaagtttctttgatgctttcttttttcctggcagaatttggtcaaagcaactatttcattgcaaccctgacttgaataaacaagtacatgcatgctcatatagctgtgtatactcatgtgggctgctttagtgccttgactcaaatttacattactttcaagtataaacaatacaatactaatacaaacaattttgggagacagtaaagtttagtactgggctctataatatgcttgtgtgtttttggaaatctgtaccgtgcattggcaatccagagagtgctggtggagacaggactaacacaatggttcccaactaaggttattcctagagaagggcttctcaacttcaacactgttcacattttgggctagataaatcttggttatggggagctctcctgttcattataggatatttatcagcactcctggcctctactattagatgccagtaacatctgttctcctctagccatggcaattaaaaatgtctccagatattgtctagtgtcctctggcggggagggggcaagaagagcagtttagagcatggcatgaaatcccaggggcagggtgttgggctaattcaaagaggcttagggttttgaagcagtgagtggtgagaggagaagaatgatagaagaaataactggatgtgtctgcagcattttcttcccatggcattgcttcttgtaagatacacacgcacactcacactcatacttttgttctacataacatatatattgtgtagtatgaagtttatgagttataacactgtcgtcagagttatacctttatcctatatccagaagcataagacggtaacttaaaatctgactgttttatctaaaaatgtgctttcttttgggtattgtcaggactcttggtttcagttttaatttctataaatccagagatttgaacaattcccctgctagcttctgtttctctttgtgtcccagatctgtttccctccatctatagccaggacaggagtaacttgattctgagaaccctgagcctaccccaaaaggtaaaggaatcacctttccctatgtccacagattaaaatgagaaaaacatttttgggtttgcttgagtcttaagtgttcttctgacctaggcacttctccagggggctggacaagcctggctcatctaatttctaccctcccctagcccccaactttccaacctcgcaaacaatcataaggagtgctccccccacctcaaaagcagagatgctttatttagtactctgaagacaaaatgaagctgcaatttctttttgaaaatcttccccccagtttttcattcccttattttcagtgagatattcatcctctactttaaatgtacattctcttatagtagttctcaaagtctggtcgaggaaacctgaaggggtagtgaaaactttcaaatggatgtcagatcaaagctatttttgtaataatactaagaaggtatttgcctttgtcactctcagtctctcacaagcatacagtggagttttccagaggctgcgtgacatttgatgtcacataagagcgaatgcagaagcaaataggaggatccatttgtctatgattaagccagacattaaagagagatttacaaaaatgtagaacatgctatcctcctcattattttttgctttatataatattttcccattgaacatgctatttatgttaatatgtaatagacttactgttattttatgaattgaaaagtattttagaagtttccattttaatttctaatgtagtaaatatcaataaacctaatccattaattaaaactctttagcattctccctaattttaagaacgccttttgtttttatggtcttacttgaatacctgagtcttcatcaagttcttgccacgatggcttttagaactccaacatttccagcccggtgaaagccacagaatcttttcagctcaagccctccagtggatgttcacaattaaaaatttcccattttttcctgtatttagatgtctctttgctgtacaacaaggaacttaccagcggtcactacacatactggattataggcaagatagccatttaagggtagcgaaaaatgtaagaatttttatttatatattttatgtgatttgaaacgattgtgatttatatttcattatgtatataacatcagtaatagagtacatatgtgtactttagaaataaaaatacctaattagaggtgtatgctttattttctaatagaaatatgctatcaacaaaagtgatacttatcctataatatttgagcctgttttggggaaaattataacttgatacagagtgaaaagaataaatatttcttttagaggatgtgatggttaattttatggttcagtttgactgggccacagagtgcccaaatatttgatcacattattagtctgggtatttctgtgaggatgtttctggatgaaattaacatttgaattagtagatggaataaagcaggttgctttcccaaatgtgggtgggccttatgcaatcagctgaaggcctgaatagaacaaaatagtgaccttcccctaggaagagagaatttccctgtccctactacctttgaactgggacattggcttttttcctgcattcagattgaaactgaaacattggctcatcctaggtctcacacctgtcagccttcagactggaaatacagcatctcacgtctactgggcctcaggcctttgaacttggactggaaatagactgtcagctctcctgggcctctaacttgctgactcaccctgcagattttgggacttgtcagcctccttaattgtgtgagccaattccttctaataaatttacacacacacacacacacacacacacacacacacacacacacaatcttactgattctgtttctctggagaactctgctacaggagattacacaaactgtaaaggaaatatactatcgcataaattaagcaatgatctctataacttcttcagtctgagaactcattccttctggtcactggatgccttacaaggacagaatagggaaataggttttacttgaagcaagaataggaatggctgtaactgtttttgaattagtactgtctgtgagcccctgggcaatgaaggtattattgtctccattttacaaacgcagaaatcaaagctaagaaagaatactttgcccagggtcctacagaagtaaataaagtagctagaatttgagccagcctttttctaactccgaggcctatcctcttactagttgactatccataaatcaattttctacctataaagcttccttggacttgagtatccataaaacaacttcccacctacaaagatgtaggtaggaaagataattttcaaagtgttttaaatgtagcattgcctaccctggagttcagttaagccacaactgatctgtggtaatttggggaaatttcatcaagttggtctagaattacagactcctgggaatagatgtgtgtgtgtgtgtgtgtttgtgtgtgtgtgtgtctataaagtgccaagcttattttccaaaaggataaaggtatttcccagtgagtaggaaatgtttgcattcttcatgtatttgtgcatggatttccaaattgatggattttgcttcaaaattagtcaagaaatcaatcctggaagttattgtgtgtgtagctcaattcagtaaagtggcaaaatattatttatttcatcctccttatgctatttagtttccatctcattcctcatggtaatggagaaatagtctatgatattgtaaacacatatggatctttaagatttattttatatttgttttagcgttcaggaggcacttggcttttgcatctctccctctttaggaaagaaaaccaggtcatgccttatattttatatatgttttacatgtatttcctttcaaaaatgtgtcatggtatacttagtccttccctttaaagaaaaccataatgcagatctcattaaggaacataaatagtgatacatatatatggaaaaggacacacattctttagtgcagtggtgggaactagtgatcttcctccaaatgccagaataaatagatgttcctagcaaaaagcagggactatatttggaacctcccctattctggagttccagatctgattactcatgtagaatctcctgtttcatatataggtgacagtgttcaggactcattaccccaaaacatggcatcttagcatttgaggaaacagccaaagcagaccatacaaactagaaagaattcccctcaccccttccccactgaagtaggtcataagaccctcatctggaggagtcctgacttatacccagaggaaagcaatatcacacatggttgccaagaagaatttgaacaaacagaatttgctaagttcttcctggtttattactgttatattatacccttttgtcttccaatcatacttctgcacggctgtccattaaaaatacacagttttggccgggcgtggtaatcccagcactttgggaggccgaggcgggcggatcacggggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgggaacccgggaggcggagcttgcggtgagccaagatggcgccaccgccctccagcctgggcgacagagcgagactccgtctcaaaaaataaaaaaataaaaaacacagttttccccaggtctttaattatgcatttctgaataatctcgcatcatgtaaaacttacgttaaattaattgtatgcatttctcttattaatctatcttttgttgtaggggctttagccatgaacattgataggagttagaaatattttcttccttacacgtatacagttggccctccatatccttgggttccacatctgcggattcaaccaactgcggatcaataatgtttggaaaaaaaaaacaataaaaaataacaaaaatgttaaaatacagtataaaatctatttacatagcattttcattgtattaggtgttataagtaatctagagatgatttaaaatatactggagggtgtgcaggagtcacatgtaaatacgacatcactttatataagggaccccagcatctgcagggggttctggaaccaatcccatgtggataccaagggacgactgcattctccaaatcctgggcatgggcataccatatttcttaacatagctgcttaccatctctaatgttgtctatttaccattttctataaatctactgggttttaaactaatttttgatatgaagaaagtttatatcaatataaatagaagtaaaatttttcacaaatggaaaataataaaataaaaattttcacaaatggaaaattaacataaaaataaatttgcaaatatttacaagcgtaacataaatacacatcaacttaaactcaaatgtttacaaaataaaaataatactgtctaccagcagaagtgcaatgaccatattttttaaactatgatttctcctatatgtctatatttcatggctgaaattgtagttcagagctctcaccatcgtttctactacatacaaatcacttatgtcagtggaaatgttttctgccaagaagtgccaaattgtgagcctctcaggcctccagaccatgtttccttcacttctaaacgccattatgtcacccactgcatagttatctagtgcatataggataaacgctcaacgaagaaagccaggtcatgctttacaccttacattttgttttagacatattccttttcaaaaatatatccctgtgtaattaacccttctgtctttaaagcaaaggagttaagcactcaaatggcaatcaccaggaatgaggcccactacagtctaggagcaccagggcagtgcagtacaaaaaactcaagtagagaaaccagtgataactggggaaagttactttgactcacagaactttagttatcacatctataaaatgagataatacactctgccttattgaggcatttttttttattaaaaacagcctttgctttgtaccaggaaaaattaaaagcacttaataagcattaatttatgtagtcctcctaacagcccttatgaggctgtaaaggaacaaacaaacgtttctctctacttacactaaacatgccacactttttgaccagatgtgtgggttttgatttctgacacatccattttcaggtacatagttatgattccatttaattccgatgctgtctacctggagttacagtcagaacccacatgttaagagctcggtcccacgtgaatgccccctacttcagatgccagtcctaaatcgggctccccagaacttctggccaattgatataaattagagattcccatgaccgcctccttgggttcagccatttgctagagtggctcacagaacccaggaaagtgctttacttatatttactggtttataataaaggatattataaagaatacagatgaacagccagatggaagaaatgcataggaaaaggtatgtgcgaaggagcacagatcttccatccccaagcacctccacatgttgggcaacatggaagctctccagttgcagtcctttttggtttttatggcgacttcactatagaggcatgattgattaaaccattggccagtggtggttgagtcaaccttcagcccctcttccctcctgaggctatttaggagtcttgggccaccagtcattacccttctaaaagacttatcactttggagattccagggattttaggagttctgtgtcaagaaatgaagaagaaagaaatgaagaccaaatatatatttcttattctaaagcacaatatcacagaggaaaagagggtcagtatcttaattttataagggaggcatttataagacacagagaatctaagtaatttgtggaaggtcactcagctagaaagtgaagagctgggttttgaaaacccagattctggactcaatcattactctatgctgtatttcttcttagagtatatgaaattatccctgtgaaaatagttagactctggcattctatagctgttttctgtgacctgtgctctatattgtttttctttgcttcacagaaacgtaggtactgttttcccctaagttgttaattaatactcagataaggggcaagcacctctaggaaaaatcaaattataaatgtccagtacacttttatatcacatcacataatgtgacacattaaacagttgtggaatgtcaaaaattggcataatagatgacttgggaatgtagagtgacaagttttcatacaattgtgcctttttttgtgataatggtaaactctggaaaatttcattttctggttctgcagattgccagcacattgacatttcctgtatggtttcccaatgggaaggacagaattgtatttagccaaatctgataattttccttagttgaaattgaaggggctaaaatgcctacctacacttggatatgggcttcaattttttttgaagatacttattttccttctttgtttctaggatatagaggcagttcaggtagtttttcaggatactgcattgtagaagtaggcccttagtgaatcaagccattcatatacaagttgagtaagtgctcagagtaggtgtctatattaaggacagggtcctgtacattgtggggtgcttagcagttttgccatcatctgcccatgagatgacagtaacaaaccccatcttccctatgattatgacaaccaaaaatgtcttcagactttgccaacaaattacctttagatgtaatcactgatttagagcaatagaatttttggctctgtagggtaaatgaagtgcacctgatagcaataaatgacgcataccctgagaatgaccctgtatggcagatgcacctgaatgtgtgttccaagctaaggaactcgggaatggccaacagggagattcattccttgtctatgaggaacatctgaacctccagcctgtctattggaactcaggccacacaggggctcaagaccccgagttttgggttgaatgaaggttgccaggtggagactgtttgggaaagggtgctgagtgaaaatgctatataaactgcatgccctttgcaaatgattgtagttttcctgcccagtcccctgccgctgggctgcggagttatcttgtctagcccactgctactgggctgtttgtaaggcgattctcctgtccagcccaacaccactggcctttctccgtggtaagtaaagctccagtaaaatcccatgtcttgtttgctggccctgggtctctttttcagtctcttgaacctggtgccatcccctttagagtcgataggggttcagcgtgacaggctctttgttgtaaatatttgagattgatgatatctttgcacatattggaaaactttagatttcaggatagtaacttatgggccacaatgccaactacagctccggtaatgttacagtatgatggtttttaatgtgttccctggactagcattatcttttacaaataaaatcaaatcacatcactggctgaatgtttgagatgtattctcttctcattttaaggtttacgtaagtaatctctccaaataagtataatattaatagctgacagataaagagtcttttatatttacaggatgctttcaacttagtcttttctttaatttccccagtaactctgagaagagtttttattcacccatttgattagaaacagagacttaagaagagtaacttctgtctattctgagttagggagatcagaaaataccactgttctgagtagtattaggtgagaagagttttcttgctgattaaaatcctcaagtaaagctcttacatataagacttttatatataagaacaaaaaaccaaacaccgcatattgtcactcataggtgggaattgaacaatgagaacacatggacacaggaagggtaacatcacactctggggactgttgtggggtggggggagtggggaggggggagggatagctttaggagatatacctaatgctaaatgaggacttgatgggtgcagcacaccagcatggcacatgtatacatatgtaactaacctgcacattgtgcacatgtaccctaaaacttaaagtataataataaaataaaattaaaaaaaaataagactttttcctatcctcgagagcagtgtcaaaggctcatgactgtttttctcctgatctccaaattctaaaccatgtgctgcagtttcctatgttgatgtcactggttgttcaccctgggatgtcctatagactggagcatctgtctctatcctctccaatgagctgtcctaattatgttacatcaagacaacttgtgaagctcagaatctcaagtttctggccttacaactgatgagcagcataagccattcccactgctgttctcaatcccctccctgtcttagattcatagatccctaggctcttaagtgtcttccagaactgtttatcttgtagtcaagacccagaaattagacttccagaaacatagctcttcaaggcaggttcttcaaggtgatgatgcctgtgtcaccttgataggaaacctcctacactgtgtaatactgtcatctcagggagagccactgttcattagcttaaattgtcagctttatggttcagtgaaataaatacacattttccctaaggtaatgacttttttctcacttcgtgagagctgtagggacccttgttatcaagagataatcatattctagtggtgctacttattgtacccaatgaaagtcccaaggatgtgattatctcttaataactctaaagcctgttatgtatcatcttgtattttgtttactttgagtgtgtggtggggaacccattagtgatctctgtggttgatagtattcgttgtgaaatgataaaagaatcaaatgaccatttgtttgcttggagctagacagcacgattagaaatgcatcccaattctgactgaaaaatgcatttaaatgtaatctgttgcttagtattagtttaataaccctgatgttaatactaaattatatcaagcaaagctaatggaaattctgaaaataaacatggataatttagtatctacatgacctttacctcccacagaaaattcaggttgggttttaactacctgtgaaggaagtagatacccatgagaaataacctgctgattctgtgatggaaaatgccatcaataagttaagcaaaacaggagaaatataaggaaaagcctgttaaatacaatggcctttaagaatacggacagttgttaaatggtaactcttacctctcactttaggctatcctttgatattcaaataatgttaataataacaagtatcattaattgaatacctgctatagactggtttggcttgtctcattttatctattattgttattgagatggagtctcgctctgtcacccagggtggagtacagtggcaggatcttggctcattgcaacctctgcctcccaggttcaagcgattctcctgcctcagcctcccaagtagctgggattgcaggtgtgcgctaccacatctagctaattttttgtatttttagtagagatggggtttcatcatgttggccaggctggtcttgaacttcttacctcaagtgatctgcccccttcggccttccaaattgctgggattacagataggagccacggcacctggcccattttatcttttgaagaacctttcaaggtagataattttggccctgtcttacagatgataacaacaaactacaagaggttatataacttggttgagttcatgcagcaaataacgtggtaaagcttagactcaaatatgactttagaacctatattttgtccactgattatttaaaggcataatgtacagagtgactaagcgcaattataggagacttgtaatcaatggtgatcacatacacatttgttgttagacaaatccaggtctgactctaacaggcaaagtaaagagaccactctttggtccctcctaatgttatatgctatgtctgtgagaattgaaagctttagagatgccgcatctgggtttttgaacatgttcgttagaattattttcatgctcttacctgtcacttgggaagggttgtttttgttcttaataaataaccgacacaccttttggttttgaggtatttggaaagggtctagatcaggactgtttgttccctagggtaaaatcatcctttttgacctagaccttgccagctgctgcatctaactatttgctattagctgagaagctctgcagtcattcatggatttctggttcctttgttgtaaaattgcgagtacatttatgttgacagcagctgatttgttcaaagattggacccaatctttctgggcagagggagagtcgtctatttattcacctggttgtgtattaatttcctgcctattttcacatgtgattttatttagtttataataaaaactttaacttaggatagcgggtacaagttatggattgaacatggaaagtttagtgaatttttcatgattaaaaaaatgattataatgatagcatttattttctgcatagtatgaactgggcagtgttctcatggattacctcagtctagcctcaaaacaacagctaaaggtaggagtacattaggctcattttattcgaaaggaagctgagcttaaagaaggtgggtaaaatgaaaggtcttgccttgtgttcgcctctagggagagactattagccaatcaagtgcaatagattcagtttctttccccctgtaaagcagcacaaaagcggcccagaaaaaaattctgtgggttttttttttttttttttaaccttctttcaaggtatgaaattgggtatctacctacttgaatcatctctgttcatgctggctaacctaagatgggaagttttaactatgtctactttttcccctaacaagaatacagcaactgaacattttcccagtgaggtgtgaataaataattcctgcttatataatcagcaacttctcaacatcaactgaggtatcattagatattttcttttaagatcagttatgaaaatccactgtggaagtggaacttattttggcgtaacccttagtttataataactaagactatacgttggatccattcaatcattgagcatacatttaaggagcacctgttttagaccaggttgtactagactgtacaccttcagactgaagaataagacaacacaggtacatactttcccacagtaaaaggtatgtgtgttttggggtaagccgaacagtgataaatattttgtgatgagtggtatgctaaagacatgtgctgagtgtaactggagcacaagatccattacggtcctgagaggttatggttttgttaaaaggattatttcaaaagtaatattctcttactgttttagatacattttgatgatgtttgttgtttatttgggggggggaggtggcagagtagagtagtaattttattttgacagcaaatcccaggaggtcaggaatcttggtctgtttcttttctcctagtaaatactttttgaataaaaaaaattaatgtcaatgtaaaagctattggtctatgatagtaaaggaacagttgattatgattcatattcatgagccaggaatttttatatatggaatttccttacaaatttgtaggttgttagcattgtgacttatttgtattcattgctcacttatttgtctgcctcatttctacaggcacaaagccaggactttgtattactcacagaaaacttagcttcagtgggcttatgatttcttaactagtaaccatttagttgtaatatacagaaacttaaactagctcacataataagggttgttgaaaccatatgccaggcaaaatgatagtcttctaagcataaaaaaattatagctaaaacctaacctcatggggacttgacttaggaagtcaggaaatgtggctgcccctcaccttttaccctattttcagttcttcatttctcatgtggatcaggagtaaggatgtatgtaatcctaactctggttttctctaaagtcttatttttctggttctctcaagactggcttctttaacaataattccaactttacatgcctcaaactctcaagtgttgcaattcaaaatctctgagagagaatcttgttgacttaatgtgggtcaagtattaattgatggttcaatagctgtagcctattaggttgaatcacgtagaacatagggctggtcttttcaggagcaacaggtgggatgcattctttacaaaggagatattgtttcagaggccttcttggggtcagtcccatatattccccctcactcttcttacctttccatcctgctttctattctctttggcattgctctttgctccgtggtagctaactgacctgataaatgcattcatgatatgttagttcacccaacagataagttcttttggccaggattccctctggatgcaattacaaaaatcaaaggagtgaatttaataatgttttctataatgggcaagtatttgggaacatatgttttcttgtggtgctgatactgctttttgtgtgtacagtcaccatgcatgaaactatccataatgtatgagaatctcttgccaatgttactgctactagtggatactataactagtggctaaactgaatagctagtctgcattatgtaatttaattattaatttgaggattgaaataatcctttgaggatgaatactgttattgtccccactttaaaaatagaattgaggattatatcaattaaagaattgttcaagatcacatgattagtaataaattgaaccaatatcccatcccaagaaatttatcccggagcttatgttctcaaacaagaacaacataattattttaatgaataaaattaagttttcatttcaagtattattccactggatagggtaaatgtaatctctaccttctttctgtgaagaagaaaaaatatatatgacaaatttttagtaatatttgaaaaaacaaaaaactttgaccgatgtctgtaggattattataattttaattgttattgataggtaggctggagttgcaaatggtgccaatagctgtaaatagagctttagttttacatcagttgctgtccttaatgtaagaaagataggtgtttagatacatactaaacttttgtagctgactaatgtatatacagctggtaactgaccatattaaaaccaaacagatggtgatgtatttgtgattcagaattaatgtgaatatataatttttcataatccataggaaacattttcttacacatgtcatcatttatgaaattgtatttgttttaggggtatatgagaaaggtcagggattattttacatttctgaatatattagcaatatgaagaatacctgtttagtctctaccttctggttgttatcgatattatcctgagagtaaaggtagttaggtatttaatatagagatgaattattttgcaattcagccagagaaggcatacacttaagaaaagatcatgtttttatggctaatcaagaaactataacatttttatccaatcaattatgttatatttaagaataagccagagtagaatagtatgattaaagatatttctgattagctaatctatattatatatatctacataaaattttattttcagttattaaaactataagacagttattttacaaagaagtgatctatagcagaaacttggttagaggatacacatatgaataaacatgaaaacataaatatatacctttattctacgtaaaattaagtgtgtgtgtatttatatatatatttatagggaaaataaatttagttcttcagggaaaaatattgtgaggcaaaaattatttcacaattaaagtttaagtcggtagctttaagagaatgtacaatttatgtgaagagtgtttgtttttgttaggtaccctcattttatgtattcatatacctaacaaaaacgatgacgtctccatttattgctcaatttttattattttaaaatccttttaatgtaccctcttaagaaattgtctcttttattgaatctgaatgccataaaatattgcaggctcctagagccatcatactaacaagggaaagatagagtggtgatgaccttctcaaaagtcactcagctcatgggaggcaaggcggagaatggatcctggatcctaatctacacaattctattaagctggaaatctataccaaatgtatttaatttttactttgtcctaatccaatctgatttaattttagaccgggaagattacaggtaagcatcacctacccataagcctatctatgcttgaaaaaatgtatttatttgtgtattttttctttttattctaggaatcattgacatagagtaactccacagcatgtgtcttcaagagcttccctaaaaggtaagcttcccacaagggaagattttccttatgtgtagttcaccttgattagcatccttagtttctatggaaacattgaaaaccttcccttacagagtgatagcatgagattgtttttgatgtttttatgaatgttgaaattaatgaaagtagtgaagttacataaattaaagcctgaaactaagaaatagggactatttacatttctctctggagaagatacttaaggtaggttttctgtagtttagattaatttgataatccaaaaattttagaatttgtaatcatagaaagtgtatattgggaataaagttgttgtacttttgccaaatggtttcataggagaggatgttttagcagtcaaaccaacacaaatattaagttaacgcagtcctataaatactcagatcttaaaagttgaagcttttgaagggataaaacatgagaaatgtaactcactgtctacaatgtatgcaaattttttccttaataaaatatatagatgtaaaacagtaaaatggttatgttttactttcctgatgctgatccaataaagtaactggtggcttaaaacaatggaaacttattctctcacatttgtggaatctacaagtttgaaatgaaactctcagcaggaacatgctctctctttgaaggctcttaaggaggaatctctttgcttcctctagcttctggtggttgctggcaatgtttggtgttccttggcttcagatgcatcagtcaaatctctgcctctatcttcagttcacgtggctgtctcccctatgtgtgtccaaatattcttcttcttaggaagatagcagtcattgaattagggcccatgctaatctaatatgatcacatcttaacttgatttttatctgtaaagatcctttttaaaaagtcacattcacagattttggagattaggatttcaacagatcttttagggacatctaattcactcataacagtatgcctaaaaagagagtctagtgaaattaaagttaattattgttaacaatgtatttatgggaaaataatcataacatggagtggaggaaggtctcattccattggtatacataaaatgctgtttattttaatgatataataattatctcttgatggccagcttttctcccaagcaagataaaaattattcggtacagggtttgataacattgggtaaaatattagtatataattctgattctcagatttttaacaccctcagttaaaaaaaataataatcctggacatcagtgagaccctgtctctatgaaaaacaggaaaatttagccggatatggtggtgcatgcctgtagtcccactactgggaaagctgaagcgaaaggatcacttgggcctgggaggtcaaggctgcaacgagttgttattgcaccactgcactgtagcctgggtgacagagcaagaccttgtcataaattttatatatatatatatatatatatatagagagagagagagagagagagagagagagtcagaaatttatttcacttgattcttcaggtatttttcatgagctaaggttgagtaaggtgttttttaaccaactggctattgttctgtaacaaaccaccccaaaactcagtggctaaaaacagtaactttattatttcctatgagtctttgggatcagctgcttgggtcttctgatctggaacagactctgcagtattgactgggtatgctccttggtctgagcgcagctcacaggtcagtgcaagctgctccacaaggtccctctcctccagcaggaaccatctttcttaaggcagcaacattattccaagatactctgagtgtcctcaagcttgtttagatgtgctgtgttttcccttgcttttacttactctgttccttctccttggaatattctttctttccatctttttattccacttgaaaatgtatttcctttatgaatactgctctggtttctttgatcctattcattcatatatctttgtgtagctgaagatactgaactcatatccctgttagggtgaggcttccctcttgtgccaacatcagtgtaaacaatatgatattcacattgtcttgtaattgctagcttaattatcttaccctcccactgtgaacttctgaagccagtgattgcatcttcttgttcttcatggtattccaagaacctagcagtgcatgcacagatgatgtcttccataactatccatggacagaatgaaagatttaatgacatcttccctattctaattcctctcttaaaatttaagttgttgaaactttccagaatttggactgaaaggcaggaggtaggtttcctctcattttgatgatgccccttggactctactcaaagagggcccaggcaccctgtggtgccaccctggcctttcttcctctaccacagattgtaaaagttgtagtctgtgggacagaatatccccaaaacagttaatttgatttacataatagctctttttaacatagtaatttcaaaaataaaaataaagtttaacttgttgccagcacttaaaaatttggagattttacataaaatgattttttaaattctcctaaaagaaatcataataactttctatcctggacaatgcatttccagatgacaaagagggcttagctgaacaatagcagccttccagtgccctctccagttcgtcacaccatgccatttgctatcttctagccccagtagacacttgagtttaatatccttagctacccaaagatacatggattgatacagtgtggaggcttagctttgcttctaaatgtctgaacaaagaagtgtcagtggttgaatgggccatttagatgttcttattatatatccatcaactaagtaaaaataattttggctttgttttcaaagctctgtacttgaattcctgcatgtaatatttgaacagataatctctctgacctcttttttttacacatctgtaaaatggagactgtgatattcttcataggcttgggtcatgttaggttactttattaatgctagacaatttagtctaaactgcactcatagggaaaatagaagaagacagttacattcttctttttctggattggtacaaaaattttcatcttttgttagggtacattagcaatatgaagtactgatacatgcaacaactgggataaaccttgaaaatattataaataaaacaagcctgacaccaaaggtcatatattatatgattccatgttgatatggtttggctgtgtccccacccaaatctcatcttgtagttcccataatccccacctgtcgtgggagggagccggtgggaggtaaatgaatcaagggggcagtgatcctcatgctgttcgtgtaacagtgagtgagttctcatgagatctgatagtattagaagggtctttcccctcacttcactctcactattcttcctgctgccatgtgaagaaggactttgttggcttctccttccaccatgattttaagtttcctgaggcctccccagtcatgctgaagtgtgagtcaattaaacctctttcctttataaattactcagtctcaggtatgtctattttagcagcatgagaatggactaatatacatgtataagaaatacctagaataggcaaaactatagagacagaaagtagattaatagtttccagaaactaaggagagatgcaagcgggcagtgactgactgctacgatttctttttggaggtgatgaaaatgttttggaattagagagtagtgatggctgtaaagccttgtgaatacactaaaaaccactaaattgtgcagtgagtggtgaattttatggtatgtgaattacatctcaataaagtaataaggaaatatatgttttaggaagacaaaatttcatcttcagctgaggcaggagaatagggtctggaggcagggtaaacctaagggcaatttgcactgacttcctacaactgaatcaaaaggaaaaccccacctccccacaaccaattaacaaagggattagaggctactccctttgtactgcattgccgatgaaaaatggaaagtacctctgattggttctctcctgcaaccagtcacactggtcacgggccaagtcttcatgtgtaactttgtaacttcacttcagcctctaatttgccccctcctgcaaccaatcagacgtttgcatagggtgtaactttgtaacttcacttcagtctcttattggtcactctctgcaaccagtgagactggtcgcgggtcactccttcatttacatagtgtaactaagtaaccagtgggaaacctctagagggtaaaccccagaaaattctgtaaccagtgctcttgagccacttgctcaagattgctctcactatgtggagtacactttcatttcaataaacctgtgctttcattacttcattcttttgttgctttgtgtgttttgtcctattctttgttcaaaatgccaagaacctggacaactcatagtcaagaccctccactggcaacatagctatggtgacattctcagtcttttttgcattgctgaaaaggaatacttgaggctgggttatttacaaggaaagaggtttacttggctcatggttcttccagctgtacaagaagcatggcaccagcatctgtgtgtggtgacagcctcaggaaacttacaattatgacagagggcaaaggggcagcaggcatgccacaaggtcagagagggagcaagagagaggcgaatctcttttaaaaacaaacagctcttgcatgaactaatacagcaggaatttactcattacccaaggaatggcaccaagtcattcatgaacagtcttccccccatggcccaaacacctcgcactaggccccacctcccatctaggggtcagatttcgacacgacatttggagtggacaaacatccaaactatatcagtgatataacaaaataagcagattgtcattcaaatccacacacactgccttcctgagagtcctgtctgacctgactgccaaggccaaaggccaggtcaaattttttttttttttttagatggcatctagctctgttgcccaggctggagtgcagtggtgtgatctcggctcactgcaacctctacctccttcctgggttcaagcagttctcctgccccagcctcgtgaatagctgggattacaggcgtctgccaccgcacccagctaatttttgtatttttagtagagatggggtttcactatgttggccaggctactctcaaactcctgacctcatgatccacccgcttcagcctcccaaagtgctgggattacaagcgtgagccacggtgcctggcccaggaaaaaaatttaaacatcaggattcatggtttcatactgagattctgaatgatggggtcagacaggaatgaatttctattctaaatattttactgactacctctctcatatttctcaaaatgtaaaataagggtactgattagctcttttgttagcttaggaaaaataaatatcatgaacctactgtggttccagttaggaaatagaccctccataactgatacttttataattagtattatttggttgtaaatattaggctatcacattagatttttggcagttcaactgttccagggttggcttttctcttcctggcatcttagccagaaagaaaagaatgcctagaatttctgttagcacttaatgaatttaatcagcccccgagggacttttgatgtcagggaaatagttgacagagaaacatgatttttattctttctgtgtttctcttggtagttgacagagctttccctggcagaggtaacattacctgtgctgagagaggagtattaacatgctgtaagtgagatgttagaactaagagaacacatccctgtggccttacattaaaatgttccatgcatatgcttctgaatacaatttaagctgctgccaataagaaaataagccattgcctgaaaatgtgtgattcaattgtctatcatttttatgatttttttttaccctttcagacacattttagagattcttttttaaaaagtttgtttttggaaattgaaatgaaaattatcatctggaaatataagggataattgtgttattctgtgaagtattttataagctgtaatgttaagcagaaatttttaatcttaagtatggaaaaatatgtatatgaattgctccatttgatccaagtgatgttttatgcttttccttatggttaatggaaaggattatgctatgttgaatggccggaatatcaggagcatgggtgtcatttgttctcccaacaactatttttgggaagctaagtacatgccagaacatgtattaggaccaggtgatatggtgccaaataatatatgtatatcttctggaattttgagtttgctgtctaatagggggactgataacatacaagtagaaaaaatacatattgtgctaagtactgtaaaggaaaggaagagaatattatgatcgagaagcagagcttatagttccgcaccacaactaatttattgtgtgaccctctgataggctactgatgatgagtgggcaccgagcttctataaatttgacgaattaatcctttgaccattatggcgtgatcctctttttattcctgatgatgcttgttgacaaaatattacttcatttaaattaaatttgcctgagatttcctttctaatttgttttcaacctttatgtttagtttaggtgtatctcctttcagcagcgtgtagttggattttttcagtgtgaattttccccccttcttttttactaagggaattgaatttttttgcacttattttgattcctgaaatatttttaacattctttccatcaccttactttgtgtcaggatttttgtttctaaatgcttttccaccttcttctaaattaactggttttcttaattccattaatttcttattatttcggacgtttcactgttttcatttttagtgtgctctgccaaattttaaccttagcaaagtcaaatttaatgttcccaaataaaacctaaaattctttaactcaaattgtatcactcaaagttccaagttattttctatgcatattattttagctcaactttttcttcctcttagtaattattattatatttaatacattcaggttttaacttacatagattttcttatatactgaccagtttatttcttatcattgcttccagcatcccacttccttttgctcaaaagttcctattaaatttttagtagcttcttttaatggtaaactctctaatttttttgtatcactaaatatttttcttttgctgttatttttgaataatgttaagctaggattggaattcttagttaatggtattttcccctcaataccatgaagatattgttgtattgttttctatcctttattactacagataatgaaatctgctgttagtcaaattgatatgcttatgtatgtgatctgtctttttctttcctgctcacttttaagatatttcttacatttggagttctgcagtttcacaatgataagtccaagtatgcatttttgttgagtttttctcttacgctattctgttttccaacctcaggacacacttttttccagttgtagaaaattctcatttattatttatgtgaatattggtatttctaaaattacttttgttgtctcttttctgcattcttaaacatatttggaccatttatttctcctatccataactcctagctagcctttcacttttttctttatgtcttcattttgcattataagaaaattcctctggagtccttcagtttttaaatttgttgttcatcagtgtctattctgctacttaacttttgtatcatcaggatggctagttcatgctgcattattagcaaacagccccaagtgtcatggattaaaacaagaaaagtttatttctctctcatgcaacattctcaatgaaagttaacaggggagctctgtcttggtggaggcaccatctgggaatgtgaaggcaaaataaagaaaacctgtggaatcataaactggctcagaaagcttcctcccggaattgacacacgtcatttttcctcatattccactagcaaaagaagccaatggatgactccaaaggctataaggaaatacaatcttttttttttttttttttggagacataatctcgctgtcgcccagtctggagtgcagtggcaccatctcggctgactgcaacctccacctcccgagttcaagtgattctcctgcctcagcctccctagtaactgggattacaggtgcccatcatcacacccagctaatttttgtatttctagtagagacagggtttcaccatgttggccaggctggtctcaaactcctgacttcaggtgatccacccacctcggcctcccaaagtgctggaattacaagcgtgagccaccatgcctggccaggaaatacaatcttaatatgcacctggaaacaaaggagaactgtagtatttatgaaaagcactgcacggctactccaaatgttcatttttttttttaatttcaatttcttgttttaatttttagaagctctttttggtttatcttttttttaagtcatgttttcttgctttatcatggattcagttcctttttatttgtaattcctttacatactcttaatttctcctcatgttcattaatcttttattatttttattgtttatactgtatgtttcttttactgtgccaactgaattttttcatggtagtttttatttccacatatagttcgtaattttatagtttgagcccaccttagtgaactacttcctttctttgggaatgttgtgaactctgtgttgtgacagcattccccaagagtggttctgcttttgcttttattgagtctttaggatataaaaggtcacatatcagtttttgttaacttcttgcattttataagtagagtaaattagatcatatacttaacgcttggcccagccgtgaggtttttatttcttataggggtcatattgagtccaaagacaacagaattcctcacttcttgttcaggccatttgcatcatttttctaccttcttttcatggatttagggaatctgtgttttatatagggactttagatatatctccctgtgcttggaagactatgtctcctgtccctccttagacatcaaaaccctggctcaccagccctcaggcctatagcgagaaccaccctgtccctgaaccaccaccacattaactgaaacttattgcagagtcttcagttcctctgttcctttatcagaccttcagcattccatttcctttccttaaacttgatagatttttttaaattgttttacttatattttattcattatttttctgtgcctttaggtggtcattgatctatattagctgggttcattatgttttcaaaactggaagtttctaacatcagcttcctagcctataaaaaattattcaagttgcattatccacaatgctcttttaaccctatgactcatatcttaatatgaactaatacgaagaaaaacaagaattaataccaggtctcttgtcttctttccattttgatattaatcaattgtgtcatgttagacaagtcattaaactttcttgggctcaagcttccccatctataaaatcagcagttgaaactatatgccttagataaatgcattctcttctccaagctaagcaagtttaaatctgatgagcttttaggaaagatacaactttgtcctcagtactataatatttgattctttaattatttccagctgaagtcttttaaaatttacattattgcaataaatgttttacccgaactggtttggtaaatattttatatgcatctgtatataaagaaccatcatatcttattatacctagaaatgaatgcaattatgtttgccattttaagggtctcaagagttaatattaacaaagtgcttgttgacgtattttttttttcacatgaccttctgaagccagcctgcactactgccttttacataagtaaattagggtacatttttaaccttttcatgtttaaactaagacacatagtagctcttcaaaattgcaaaacagtctttagaacatttagtacacaataacccttctaattgcacgtgaaatgaaggactgtaaacttcataagtcacccagaagaacacaatgtaattccctttagagtatcctctttaaaagtggtctcagaatcagactccatgatttcagcaacacagtcaaagatgtactaacagatattacctaggttgccaatgaattgctgtcagttcatgttttatccatgaaaattttaaggaaaatgtaaaaatgatacatttgtttgaacttgtagagaaaattatgaaaaatccaagcttgtagggaatgatggactatctgcagaatattagcatagctctgattttgcaaacacgtggactcagataatcttacccagtggagacataccaatgcaaagtgaactaagatcttggagtactaatggacctatataacacattgagaatgttgaaacaacccgaaacaagctagagaaattggagaagcttaaacctgaggattggtgccctgaaatggaagagaaacaacagtcaactttatatgaacaggatgaaatagcatacaacaggatgatattaacatatctctgagcctgtgagggacagggaacagacttagagcaatccacccttgccgttaagatctattttgaagtgagacaggcgcttgtctcaaaggtcagggactaaatgtgtcttagagaagtcatcgtggttgttttaccttttcatccacctttgaaataaaagattagagataagatgaaatctaactagatccttgctaggagaatgaagttttaaaaggagagccatagtcacagctgtcttcagagtaggtagatgccaagtcttagggaagtacaggattaaccatgttggtaatgacagaacctaaggtatccccagcagtgttctttaagagtgtaaaaaacaaggattaggagagcaggtgattggacgcagctgctgaataatcttcttaacctcatctttactccacagggagaaaaataacaggaaaataaaagcttccaccaagtggttggtggcagtgaaacaaaaggagcatcaaaaagtacacaaggacagatttgtcctgatgctaataattctgaacaaaagggccaggaaattgctgtaaagtgctctgtactagtgtaagataaatacataattagtatacttaaataaagaaaaaaatagagtagaattctaggagtggttcttttttctaggcacttctaaagctgttattcactgagggcctaaataccttgtaatgtctcttcattaagtttttgttcatgaagtagcgagaaatgaatagctctcagtcaatatttaattgatgcttatacattgaatttaatcaggaactatctaaatgactcactaaccaacgaaaatttaagcaaggcaaatgtaacaaaggaaaatggggagcaaagcaggcaaatggtaccagattatgcatgagtaagaaatatgcatgagagaaaactttcatgtttgaagccatttgctacattcctggattactctagcacagcctaaataattctgattaatgcagcctcccaacgcatgatatagtctgcaatgaaaatggcccaaaatatataccttaatttctgtacaatgtactggttccttgttttagtgattctgtatttgtaaaagttcctatattgagtttgcttcaaccgtattgactgctgaagctcaagttctgtttatagcaaaggtcagggtctaaatatgtcttagagaagtcatagttatagttctccataattggagaactatatcgtacaacttctgccatgaatgtgagaccatctaatagtcaaactagaaagagtgaactcatagaacaccataagtaaaatgtaccccagataacatccagaccaaatctcattttatagtgcaggaaacttaggcgcagaaatgtttggttaaaagtggcacagattcacacaaaaccaaagtcttgatgttcagcatgcagaaggagagaacgtagttttccacaatttttttttcttcctcaaagatgggacaagggtgaccttactcgcattaaagaagtggatgatacttagttgtatttgaaagaaaaagagaacagagttctcatgctttgaaaacagaaagtaaatatgtatgatctcacttatccccctttatctgaggtagatacattccccgtggagtaggacagagcgtgatttcttcacgctactcggaatggtgtagaatttaaaacttatgaattctttatttctggaatttcccatttaatatttttggaatgtggttgactgcatcaacaaactccagaaagcaaaccatagataagaggggactactgtttatgaaatctaaaaaaactgaactcacagaagtagtaaaatgatggttactgaggttgggggttgagagggggagggaatgggggattgttggtcaaaaggtacaaagtttcatgtatagacaagaggaataggttttgagatctactgcatagcaaggtgactataatcaataataatgtatatttacctaagagtaaatttcaaatgtctcaccacaaaatagaggtgaggtgatagatatgttaattagctcagtttaatcatttttgatttttacatatatcaaaacatcacattttactcataagtgtatacaattatgatttatcaattcatactaataaaaacaaacaggtctggtgcggttgctcatgcctgtaatcccagcactttgggaggcccaggtgggtggatcatgaggtcaggagattgagaccatcctggctaacaccgtgaaacgccgttgagaggtgacaatgtgctagcagccctcgctcactgtgggcacctcctcaggccaaggcgtccactctggccgcacttgaggaacacttcagcctgccgctgcactgtgggagcccctctctgggctggccgaggccggaaccggctccctctgcttgtggggaggtgtggagggaaaggctcgggtgggaaccagggctgcgcagcgctcgcaggccagctggagttccgggtaggtgcaggctccacgggccccacactcagagtggcaggccggcacagccagcccctggcagcgagaggcttagcacctgggccaacgggcggaggggatgccaggttccccagcagtgccagcccgccagtgctgtgctcaaattctcaccgggcctctgctgcctccccttggtgcagggctcaggacctgcagcccgccaagcccgagctcccccacggtgggctccggcatggctggagcctctccgacaggtgccaccccctgctctgtggcacccagtcccatcaaccgcccaagggctgaggagtgcaggtgcacggtgcgggactggtgggcagcaggggatctactaggcgaagccagctgggctgctgagtttttgatggggacttggagaacttttatgtctagctggaggattgtatatgcaccagtcagcactctgtgtctagctgaaggtttgtaaatgcaccaatcagtgctctgtgtctagctaatctagtggagacttggagaacttttgtgtctagctaaaggattgtgaatgcaccaatcagcactctgtctagctcaaggtttgtaaacgtgccaatcagtgctctgtgtctagctaatctatggggactgggagaacttttatgtctagccggaggattgtatatgtaccaatcagcactgtgtctagctcgggttttgtggatgcaccaatcagcactgtgtatctaggatatctggtggggactgggagaacttttatgtctagctagaggactgtaaatgcaccaatcagcactctgtgtctagctcagggattgtaaacacaccaatcagcaccctatcaaaacagaccaatcaactctctataaaatggaccaatcatcaggatgtgggtggggtcagataagggaataaaagcaggctgcccgatccctgcagtggcaaccgggtctggtccccttccacattgtggaagctttgttcttttgctctttgcaataaatcttgccgctgctcactctttgggtctgcactgcccttaagagctatgtccttaagagctgtaacagtcaccgggaaggtctgcagtttcactcctgaggccagcgagaccacgaacccaccgggaggaatgagcaactctggacgggaggaatgaacaactccggacacaccatcttttaagaactgtaacactcaccgtgagggtctgcagcttcattcttgaagtcagcgagaccaagaacccaccaattctggacacaccgtctctactaaaaacacaaaaacaaaattagccgggtgtggtggcgggcgcctgtggtcccagctactcgggaggctgaggcaggagaatggcgggaacccgggaggcggagcttgcagtgagccaagatggcgccaccgcactccagcctgggcgacagagcgagactccgtctcaaaaaaaacaaaaacaaaacaaacaaacaaaaaaaacataaaggagtcctcacttgatgacaatgatgacagcttatatatttagagcacatatgaaatactaggtactttcctaatccttataaacacattttcttatgacgtaacctaaagtaggttccaacatctcataacatctcttcatcttgttgattaaaaacacgtaagttcagagtggttacataagcttcccaatatctcagtgtaaatctgtagcagagatgggattcccattcagttctatcttgactccagggtcagaattcataatcacttccatattgctacagttgaataagaactgtattttgggctgggcatggtggctcatgcctgtaatcccagcactttgggaggccgaggcaggcggatcacctgaggtcaggagttcaataccaggctggccaatgtggcgaaaccccatctctactaaaagtggaaaaattagccaggtgtggtggcaggtgcctgtaatcccagctactcaggaggctgaggcaggagaatcacttgaacccgggaggcggaggttaccgtgagcccagatcgcaccactgcactgcagcctgggtggcaagagcgagactccatcagaaaagaaaaacctgaatattttgaaccttaagtgaaaggagttacataagtaggcttcaagaaatgcacccaccagagtgataccagagcaactatttgcagtgaagtactaatagggactttgtgtatgagagtctgatattagcagcaggcagttgtgctgtagtgctttcagctggtattgcagaaaaaaaaaatcacacttggctgtaagtaagctgttgattgcttacacgggtttctgtggcatgccagctctccctgccacctactcttccttatcaaacagccaggagttctaagtgaggtgagaatcccacttgacaagcaggcataaaccatttgaggaaaatacaaattaaaaggctccaagacagaaataggagcattagcagcaggaagtgtcttggggatacattgtgtcagattacatccaggagttgggagaataagtgagtcatagcctcccagtggataagccctgttgtgtcagtagctgggcagcctcagaagctgtattagctatttaaagttgccagaactgctgtgaatgcccccaagctagcatctgcttagtaacatccttgaattatgcgcagtatgcctatttctcaagtagcttcagcatttctcctaacttctgacctgtgtcaaagcatagtgatagaattttgttcgtgtttaaggacagtaatacagaatagtaaagaactagagatattttgctcaagatcacctagcgagtcaatcaatgagctaaaattacaatgttgatctcaaggaacttttggtctgtgtaaaaatatggagcataaatataatgtcattgcacacatttgatcaatgtcttggccaagaaatctcagttgtcagaaacagaaaccctcttaatttagtccaaacaagaatttagtttacctgaaggatacagggaatctcatagaacttacagctacgaagtacagctttgttcaggtcaggagcaaaggttacctttctgtatttctgggacctatttcagggaccctgtggcacttagcattctctcttcttccccaatcccctcctgcgccctcctccaacccctgaaggtattttctttcatctttgcagtttcttctttctaccttagtatgtattcagtcgatactggccatcctagctctagactaacatgacccactggattgggtctctgtatcctaaccagagattccacagtgagaaaaatctcctgctccaaacagtttttagtacaaggaaaaaccaggacctcctaagataaagagttgcattcttggcagagaacccaaagatttttaaaatacattcagaaaattgccatcaatgctcaattgtaatctaattcaaattgtagcaggggcagggtttatccctggttagtatataacaacaccgggaagccacttccttcctgccttccagacctcccctcagttgttgcctgggtgctttttaccttgattggctcagtgtttcctgactgctaatcttgtatcaaagagaatccaatacaggtattggtgtttccacttcctgttgcttacgtcatttctagctattggtggggagaacagttgttactggaaaggggtcccaatcaagaccctaagagagagttcttggatctcacataagaatgaattcgagaagagtccataaagtgaaagcaattttattaagaaagtaaaggaataagagaatggctactccataggcagagcagtggcatgtgtagctgggttcccatttttatggttatttcttgattatattttaaacaaggggtggattattcatgagttttccagtaaagggatgggcaattcctggaactgagagttcctcccctttttagaccgtatagggtaacttcctgatgccatggcatctgtaaactgtcatggcgctggtgggagtgtcttttagtatgttaatggtttataattagcgtataatgagcagtgaggacaaccagaggtcactctcttcactatcttggttttggtggatttcagccagcttctttacttcaacctgttttatcagcaaagtctttctgacctgtatcttatgccaacctcctatctcatcctgtgactaagaatgcccaacctcctgggaatgcagcccagtagatcttagccttattttacccagcccctattcaagatggagttgctcttgttcaaacacctctgacacagttgctgtcttttttcagctctggtcaggaacttattacaggcaaagtgctttacagcttaaaaaaggagggataagggaatagatgctgtctttggctttggccttctttggaatatctagcttcttaactaagaataaatttttataagagacatttagatactgttaaagactagcactagacatttttactagaaattccaggattgtcaacacaataagatttatgcagattagatggtatggtgttgtttattattacaacttgataactagaccagtacttctcaaacttaaaagcgcttacagaccacttaggaatcctgttacaaatgcagattctgccctaggaagcctgtatggtacctgagattttgcatttctaaccaagacctaggtgatcctgatgctggtgacccacaaaccgtacttaagtagcaatgacgttaagatactgttttcatatccagaatcactgtacttttcagaatagaaattaatagtctaccttcttatttcagacctgaacaaaatgaacttcagtttaggtgggttacttgcttaaggacaatatagtttgtaacagtgttggaattaaaagctagattctggtgattctgttataccaacttaagggactaatatttattatgtcgattccatgctgttttgttcactttactgaaaatcactgcatacgtagccttaattcactatcgctgtctagttttcagctctagtaggtattgtaaacataaacatacacagaaacagatttatctattttccagccaagcttttgcaaagcaaaatccaggctgcagagagattgttgattgatactaaaattttgacagctgagagtatattttcagcaacaagatgagtaacttgggctaaaggagactgatgagaataaaacttagatttattaaggacctttccagtgagcagtctgtgtcatttctcaatgcaaaaataagtagtgtccaattccaattatatgatcctgcaacacgtaatttagctttgattaattgctataaattgctatcatcttcttaatcctgtatgtatttggtatcaggctttaatgcctgtaaatttaaatactggggtactcaatgaatttccaaaataatactctacagaatacatcctatttcatttagaagtttttaaaataactccagctactgtcttttatgtaatatgtgaattctacacttatcgtttcgttttataaaccgtatgtagcagcatcagtggattgggaacacctgtgtaccccatgtgacattttacttagtgtggacgaggggaagtcaactgcagcaaaatcatttcttttgatttctaacaatttcttctagccttatctgtaggatacttgacaaaaaaaggatacaatatttctatctatttaagatgtatatcacagtccacttaacagtttgaggaatgttttggtagtttctgtgaccttgagtaagctttccatttcgagcctccgtttttgcaactacaacatgcagacagtaacacctacctcgcaggataatatggatgaaatgacagcatatttaaaagcacttaaccagtgcttggcataggaagcactcagcaaatattcttttcttatttcctgaagcatttaatatatttaggattaagcgatagcaaaatgataattctctttacttacctctggcatctagaatgctcttggtgactggaataagttttaattgtaatcaaaactgaacgattaatagtgtaaacttgctgagggagaaataaggaggacatgctttccagaaccaattaaaaatgattttagatgatctgctatttcatattccccacaccattgcttttcctattagcaggtataagtgagaattaatggcaaataatggcaacacaaatcagtactaaagtgcatagtcatttttcatcatgcagctaaaacggtattattaatgtcaatttattggttatatataatgaactactatgctggagttttgtagaaattattttttattccaatatagttacttgatcaaggagactaagttccttttataaaataccagaggatgtcatgaatgaagaaatatggctagtccggtgcaggctgtgtatgcaggagaatgaggttttctctctcacaattacgtgagcctctgcagagtgtactttttcctggcctccagttgtggttaggtgctactggtagatttataaatatgtcatagttatatcaaatattttaatcattctgagccttttcgcctcatccaagtaaaacaattgtcttctccaaatgaagtattgtaaatatttatttgcagattttaatcaacctgtgacagccctctcatatgataaaatggtaactttgtaagattcgatgccccaaagatacatctgcaccatttaattagctggatgtgagtctacagtagagtcaacttagtttttacagatgggcttattttctgattggagagaaccgcatacagctatgtaattattacaacgtataatgtacaacatacattatatatatagtgtataatactccagtgttcacttaggagttcctatctggaattggtcttgtatctgttataaacaattgtagtttctgatagaagttacataaacatggagggatttttattggtatgatttcaaacaaatcattttctaccttaagactgagtcaaatccaaactagcatgtgcttaactgaaatcatgtatatatgattttgttttgttttgtttttgagacagaatctcgctctgtcgcccaggctggagtgcagtggcaggatctaggctcactgcaagccccgcctcccgaattcacgccattctcctgactcagcctccagagtagttgggactacaggcgcccaccaccacgccctgctaattttttgtatttttagtagagacagggtttcatcgtcttagccaggaaggtctctatctcctgacctcgtgatccacccgcctcggcctcccaaagtgctgggattagggtcgagagccacggcacctggccgtatatatgattgtttattcactaattccttcacttgctgaacagatattttggagtttctaccaaattctaagtattgtgcagtatactgttaagcacaaccttgtttcaaaggaagtagtagtcaaagcagagtgaaaaccagatgaacagattattcgtcttaatctacagacttagaaggaaaaaactaccaggcattatctgccagatcttctcataagcactttcacatattttctgtcatatgaacagattatgactatttattgtgattagacctgtgttattttgaagcatgaagtaaatggaaaatgtcacaggagaggtgacattggaacaggatggtaaagagtaggagattgcaagagaaatctattctgtttgagaacttctaaacagaaggtcagtttgagcataaattaatgattaatttttattcccttatttttagcagtaaaaaaaaatattttactgttcagtttaaaaatgtttctggaatccttagggttttccttttgctccccccaccccttaaacaattctatttcatctttcagtgaactggaaatactgaaaaaatataattttgtccgtatttcagtcttctataatatgtttgcccaatgaaatatgaacacaatattgcataatactgaaaactggctgtattagtccattttcatgctgctataaagaacttcccgagactgggtaatttataaaggaaagaggcttaattaactcacagttcaacatggctggggaggcctcaggaaacttaaaatcatgcaggtaggctaaggggaagcaaggaaccttcttcacagggaagcaggaaggagaattcccaagtaaagggggaagagccccttataaaaccattagatctcgtgagaactctctcactatccggagaacagcatggggaaaaccacccccatgattcagctaccttcacctggtctctcccatgacacatggggattatggggattacaattcaagatgagatttaggtggggacacaaatccttaccatatcactgggatttaaaaaatttgtaaatgctcatcatttacctgtctgaaagagtggtgtggggttcaggatttcctctagcgtaatgagtcagaatactgattgttataaatgttcactgtggctcttttgtgggtattgcacaatgtattgttgcttttcttaagcagttcataaagtaagtaaggaagtgacttgtatcatggtcatgatataaattgtattagacaatacatgatgagatgctcaattcttaaaggaggagagattcttctttaatcttaatagcattttctctgtatctccttcctagaacataagttaacgtgtgtacctgtattaacctcacccaccttggtttgcaactcactgagcacaaggaatatttgtattaatacagttgttctaactcagtgcttttcaaccaggggcaattttgtccctcaggagatacttggtagtgtctggagacatttttagttgtcaacactggaggataggtgctattttgtaaccagtgggtagctgccaggtatcctgctaagcatcccacaatgcagaagatggcctgtacaagaaagaatcatctggccaaagatgtcaagtgtcaaggttgagaaaccctgctctgtactataccctggggtcattctgtgactttggcattgttagctcatacattcagcccacactaaaaaggagaaattgatcacctaatgtgtttatccaactgtattggaataagagctgagttattaggctggaaattacatgttctgctgctataaaaaaattttacttttataaaataaaaatattttctacctaaaaaagctgaagaaataacttctcttgtactattgtgtggccgtagcattagtgacttcattcagtgtgtagacattgagcagtgagcttattgataggccctgcgaatctgtgagggagcaggatagacacattgttctcattagctctctaattccacaggatctgagacagatgtgaaacaaataattacttaaatacatattaaaattttaatatagatacatgatttatggtcagcagaaacacagaaactatagaaagacctgagttggaggggtctaggaaaagttccatttaagtagaaaaaaggaggtgtaagagttgaccaggttgattaagcattccagggagtgggaccagcataggcatgaacttggtgcattcaaaaaactgtaaggaaccaagtatgactaagtgcagcagttaaggagagtggcttgagcatgaggcagggcccagatctatcaggggtccctatattccatgtaaaggatttctaactttattctaacaacaagagaaggagtttatcccagctctggcaagatggtggtggccgtggtgctggcagctgggttgtgccctctgcagagccatggcggccccagggctgcgcggcacacatctgaggagctgtaggtgtgactggtgggaatgaaatgaccaaggcccagcgggcaattcctgggggtgtagccccaaccatcttctgtgggatcctggaccatcgcctcccagcctacatcctatatgaggactagcagtgtcttgtgttccctgaggtggctccataggctcctgtgcactttctggtcattcctaagaagcccattcctcggattaaccaggctgaagaagaagacagcagcttcttggacacctactccttgtgtgtaagaagatagcaagggctgagggcctaggagatggataccaacttgagatcaatgatgagaagctgggtgaacaatccgtaaatgacctgcacattcacttacttgggagctgacagctccagtggcctccagctttaacctctgaactgaccaaggaccctagacctgggtgcttggatgggaaagagaaaaagggaagctgtgatgttaataaaactgctctctcccaaaaaacaatcaatcagtcaatacatacataaataatgaaaacaggggaagacttttagggagaacaactattataagattctcacataaagcctaaataaagcaattgaagaacattacagactgttttttttcctttttctttatattttcttatttttcatgtatctgctgagacaatgttccaggtttctacaggaggatcttatgatccattaattggattgaattattgtaggtatctatatctgaaccagtcaaagcctggctgattctcttatgtggtaaaatgtcaaagtatcttcatactgcacctctccattagtaagccatgtttttagcaccttgtggtaaaatatttttcagtgttactaaagaaaataaactagtatttttcaaatgtctcctatgtaatgggagggaagtaacattcattggttgtttaccaagtgctaggactaggctaagcctgtcacctctcttcttcctctaaagcaggtgttttgtttttcataaagattagaaaaccaggtctcagaagttctaaaatgccctagtaggttaagactacaattagtaattggtaaacatgctgttagaactaatctttctgactcccaagactgcaacttttctctctgcaacatggaggagctaggtcatttatatgtctcatttttaagctatataacaaccatgtgaggtagacattattattcacatattttatatgtgtagaatctctatctagggtgtctcagttagtaattcctgggagctgcagtttagatccagatttacctgactctggaaactcttttcttttcactgcactctgatactgtctacaaaaattaccaaagtctaacatctttcctccttttatagactttcacgaagatagagaataactggtcagcatcctcttcaaagtggctttctgtataatttaaagtaatcttcaaggtggtattgatagcaagcttcataaagcatggactgtagtaattctgccaaagactgaaacaataaatagtaaggtaacatataatctatagctttaatgtaggtgatttcctacaaatagaaaataaataatgcctattgcatatttccagttatatgatctcttcttaacaatcattggagaatagaatatttataacagactaggcaactttatgtttcacccatctgagagctagagctttgcctggatatagtgctataatatttcaatatgactccttaaccttgtctagttgggggcttggtttgggggtgggcaacgtggtatatttcaattaaattaactttggaaatcatacagtgctagatttgaactctactgctgaaaccagctggcagtacaactttaaccctctgattcgctgagacattttttattaaatggaaataatatttatctcagagttgttgtctcgatatttataaggtgcctagcagagtattagatagaaattcattaaattggaaagttccaacatagtcatcatcatagttgctgcccttgctgtttttattctattttgttgttaatctttctatttccaaggacccctaagggttggcacagcagggagaaaggggtcctactggaatctttggaagtgttgacaatagaatttcctttaaaaaacctctcaaatgttagctgaggttagatcatttcaaaagaaccttctggcatttgttgacaatagagccattctagatctcttttaatctagttgagtccccggagaacagttaaatagttatagtgcaggccttgcgcatgaagcaaataaagtcaatggatactttattgcactgagttgggaaattacaagtaaaaggaaaaaaattatatcaaatgtggcccaatgaatctagtttcctggtaattgaaagcacttgttagtgattccaacaaagttaagggaaaacattctattgttaaaaagagacacctctctatggtgaatctaggccattgccatgacaatatcaagtcttgtcatttctttattttactttttgttctctctgaaatatgctgttttcatagtccacaagataatattaataatagtgcgatttggctttgtattggagacatttttcaaagcatttatttatccgttggggataaggaagttacaatacaatacttgatatttcgtgtgtatttcacctggtaacttaagtacgtttctaaattttcaattttggaaactcctatggttgttctttggtttaattttttttttatgatgacagaaaagactgtaatgtgatttgaagcccttgtaacgagtacaggtaataatgtatccaggatctcttttcttctcctcaatgccaagttaccttacttggttcagcctgacagtttctttcatctgcactccctgcgtagttcctacgtttaacctgcctgaaacacagctcctcttggtccctcatgtgggcaaaagtcagccccattctctggagtaatgagtttgatcttgacattcagcatgcttcatgatttgtcctcaacttgactttctaatttctgaatgaacatgtttcccattactttccaggcccagtcaaattaatcttaatgatgttgaattacattgaacacaaatttatcttttcaaactctgttctacacagttaataataaaggaacaaggaattgggggaaatgcaaagagagaaaaagtgggagaaagagacaatagaatgtacatatatttctatcttacgttctgctggtgatgcttcttgccaaagtgaggctgagatgagatgtgagattcccttctccaagttgccatctgcctcttttgtgtgaatatcttgcaattctcagtgtgattcttgagtttaaataaaaaaatatatatataccatgttgtccctaaatacaggtcaaaagtcatccacatatagtgctgagtttaaaaacagtgacctatttcaatgctaggaaaaaacaaaacgtaaacacaaaacacagaagtctgtctatgttgggtttgatgaaaagagggtaaaatgttttatttttgttttcggttctgcctcaaatacggttttcctagtctacaaaattatattaacagtggagcaatttaactttgcattgtagacatttttcaaagcatttatttatcctttgggggtgaggaagttacaatacaatattttatccatacccaacatggcaactccataatgaatttgggtaattttattacatgatattttcagcttgttctttgaaccttagctctcaattatactactttctctactggcagcctatcaatgtttggaaagcctcttcatttcttggttatttcagtttccaaaaagtgaatttatacaggtagaaaaaagtacattttcacgttttaattaactgagaatccaggaaactaaattcatcaaataatgttgtcaatttcatataagtaaagtctttttataagtcatccacaaaattttaaacatcaggacctaaattctgggattctgattaaaaacttatgcccatttcattcatgataatacttttctaattacaattttcctctttgttaaaaaataaggctggacgcagtggctcacacctgtaatcccagcactttgggaggccgaggtgggcggatcatgaggtcaggagatcgagaccatcctggctaacatggtgaaaccctgtctccactaaaaatacaaaaaattagccaggcatggtggcgggcgcctgtagtcccagctactcgggaaactgaggcaggagaatcacttgaacccgggaggcggagcttgcagtgagccgagattgcaccactgcgctccagcctgggtgacaaagcgagactctgtctcaaaaaaaaaaaaataataatagtaataataataataaataaataaataaaagggagtggaaaaaaatctaccaaaccttggattcaaagtccatttctttcagagattttattgtaagcattatcttattgactatgttcacataacttttaagagctaaaagaataccacgtttaatatgttgcactctaacaattttaactaaaaatattcatgcttagttacagtgtgtagaaacccaaaatattaaggatatatgtactttgtgggatgatcctctgatttaatatatgtggtctcttgaatctccctatattgaaccttcattttctaatatttattgtgcagttctctctctgtggtgtgtgtatgtgtgtgtatgagtacagaaatggtatataataaaaagcagtttctagcataaacaacaaaatgaataaactacacaaaattacagaaaaaacactaatctacagaagaaaaaaatgctggacctctaaaagtgaactatttattattcttgagaaaagcttatcaaatgagacttgcaatatatataagttgcttttccagattttattttaaaaatacaaaggcaaattactagtgctgtatttgtaagattaaactgcccactccccaatcagatttttggattatttacatgaaacgaaaaacacaaaccacccttgaaaatacgaaaatcttaattatagttacggtgtacagtggataagtgaagttagaatatctttctactgatggaaaaatgtcacttggctttgagatgagtcttttttttatttttattttttgagacagagttttgctcttgttgcccaggctagagtgcaatggcacaatctcagctcactgcaacctcctcctcctggattcaaggtacataccaccacacccggctaatttttgtaattttagtagagacaggggtttcaccatgttgaccaggctggtctcgaactcctgacctcaggcaatccacctgcctgggcctcccaaagtgctgggattacaggcgtgagccattgcacctagcatctttttaacacagggagagaatccattgaaacttttttttctctgtaacccctaacaacgttcggactatttcagcctttaaccatttggccctactgagtgtcattagattggcctcaggatccgtaagtactattatttttctcttgagcttacctctacatttatttaagcatgaaccttctcagtggttcactatagctttacaattcagcactttatccaaatacagctagaaaacttctttttttttttttttttttttgaggtggagtgtcgctctgtcgcccaggctggagtgcagtggcgcgatctcggctcactgcaagctctgcctcctgggttcatgccattctcctgcctcagcctcccgagtagctgggactacagggcccgccaccacgcccagctaatttttttgtatttttaatagagacggggtttcaccatgttagccaggatggtctcgatctcctgacctcatgatccgcccgcctcggcctcccaaagtgctgggattacaggcgtgagccacagagcctggcctctttttttgttttaacctctcatttcgaggcttctgtttgatctgtgttttagttagtctgagtttatatgtggctgtgtctagccatttacgtaggtcaattggactcaaaacccatctttcacttgaacctgcctttctttacctatcctatgtgcaagttctcttgctatttattttgacaccccacaaatttatcgaggttaatagactactaattccaaagcatttctaaatcagattgagtctattctctcagatctgtgaatacctattagggatggtatttgagataaaaatatgaataaaccgtacccttcacattttcttaaataataaaaaaaaactgaacagaagtgcaagactataaaatctctgactgcattaggagatcattattgcagtgttcaagtgtatggttatgactacaaagcaagaaaataagttttcttctctggttaacttacagccacatctcaagcattataaagaagtgaagagggaaatgataacgtaaaattggatggtgaattaaactttcattgtgtgttgagctcatcctaagactaaagcacagaaacatgtccataaaaattgtgattgtttttttgagatggagtctcactctgttgcccaggttggagtgcagtggcaagatctcggctccctgcaacctccgcctcccaggttcaagtgattctcctgcctcagctcccgagtagctgggattacaggcacctgccaccatgcccggctatttttttctatttttagtagagacacagtttaaccatgttggccaggctggtctcgaactcctgacctcgtgatctgctcacctcaacctcccaaagtgctgggattacaggcgtgagccaccacacctggccccaaaattgtgatttttattggttataagacctaggcattgtccctgtttttgagttttggaaagctaacattttaaactcctgttcacaaaacaggtgagagtaggactttcccctctcactgtgctaatcatattactatcgttggtcttgtatcaatttttaaaacatcatagccattattattttgcagtctgtattatttcttctaagtattaaatgacagatattgatatgaagagcaagaggctctccaaggaagcctcatctgtacaaagattagcaagaggttgcagcaattatgaaagttgccagaaatcacaaatgttcctaattttagggagaataggatgccccccatcacacataatggctttatcatcaggatttgagcccatgcagcagaatatccaggttctcttagaaaccagatgcttccttcctcctgcttggaaattggaaatatatttacatcttcaagaatgcgcgaggttcttctctgaagcagagccctgcattgcatctaattgtagaaattacaaaacttgtcagaaagttaaaaaaaataaaagaaatagtaacagttgcattgatttagaaccagctgcctttcttttatccaccctgatagagtagtgctttaattatttctcctaactaaaatgatacttccctcttgagaatgtctgggcctgtttatactgtcaccatcgttttgatacacaattgtccatattgatactctgtttttaccattaattttccaaagagcctctgaactcattgatagtgccggaacacagccttgccaacacagtgcccagccctggtaaactgagtcccgacaccacttttagttccaaaatttggggaaaaaatattattttgctttcacattctctctgctctctttaatacacacaactgaattcacagcctgaggccagcagagagcttagttatccacatctaaaggccccatgtcacaaaatttatctctgatatttaatatctttgaaagcacttaatacaagcccagtgttagctattctgtagtatgcctgaatccattaaaatgaaaaaaacctcagtaatgatattatgttgaagagaaatgttttataactgtcatactttggttttcctgaaatcataaaatggtcatgaaaatgatttacaaaaaaactgggttagagtgtaccagagtaccatagtcaagtataatgacatccaaaagaatgaaatgagcatggatagaggagggagaggtgacagagtaatgaattgccccctactgattttgttcctgtttgatctgacaacattggaatgacagctgctgaatgagacaatttgattcaaatgatttgcatatttttcaccagaaaaagtggtttgtagtttatggaatgagtcccttattctaaatatggtgctaatttcaagtacaggtatcctctgatattttgtgtaagtgaatgtgttacttattgttaaccagtattgatgaatttttattatagatccaaaaaatgatataattttagagatttatcccaatttctatcaaccagaaggtgaatatataccagttttccaaattacatggtgcatccccccacctccctcttttggtggaagattaggcatgcagtttttaagacccaatcaatctattgatagtgttaagtttcactatcctccacctgaaaagcgtgatttaaaagcaccaaactaagtatagcaaagttcttgcattgcttggcaatttcataatttcaggtttatatcgagtgagaattacaatgtgaaggtctttacttgttttgggctataatttgagatggaagtgggagaatgtgtagaatggttgctgatcatatatcccagatgctgcatttgtgggagaatggattgatacccagaggttccttctaacatagttcatcaagccagccagaaatttaagttaaccttgatatcccctgaggttaggttcccactgcacttggagtaaagactagcattctttttgtggctcatacatgccactgtgccattcaactctttcttttgtagcacttattcaaggtacttactgcctttttaaagtttgctcatctgtcacctttcaatacaatttacctttaacaccctatttaaaattacaaaccccaaccccaatgctctggctaacttttgcccttcactttttccttttttcctctagcatttatccttgcatctgtctgtctcagcatcttggaatatgatctcaaagagcacccgattttgtccgtatcgttcaaagatgtaactcaaatgtttataatagtgctttgtacatagtaggttctcagtataacatttgttgaatgagtggttgtttttgtatttcttttattatttaatttttgttcctccgctagattcgtgttcaggattatatccccagtgcctttcacttatttttcatgtaacatatatttttgaatgaatgaatgaatcaagaaaaaggttctggaataattttaatatttacctgtctgttaaaatattctcactagacctgttagaaactcaaagctaaattgaagctgatgtgatttctattcactaatttcctctggcaggcagtgattgggaaacatggtaaataatcagcgcatgtagttgtgctgtttaaaatacagcagttggccaagttctgtaagtatacaaatatattttcagtagatgagttaaaaccagcatctgattactttgtgctgtttggcttaaatagaaacaatttcatctcatttaaataaacaatcatcatatttttcatataaatgatgatataagctctggtaataagggcttatgttattgcttagaataggaaagttgcataaatgtgatcactctcaaaataatcttttgttacatcctggggagggggtaatgacaagcacttgcagtagctctatttatttatttattcatttttattgaggacatatgcttcagaggcttaaaacttaaaagattgaagcagtattataaaggagacataaatggcttttaatgcttgctgaaagcagataaacttaaagacttatgaacatcgtggctaggaatatgtgatagaatgtagaatccaaagggcaataaaatataaatatgtttctaatttgtgtattcttccttgtttaccataggatgtgacacattcagtgctacaagctgactgtctatgtccatatgggaagtatacacattgttctaaaactataaatcagggacatagttgaaatttgacaccaggttccaatccctaatgtcctctgaaaaatgtgagtttataaaggaaagcaatgtttccaagtaaattcattgtcttttggggctggctagctggcttttagagcctgacaggaatgtttttatttcttcagctctagaaaaggaaaagaggaaggaggcagtagaaaaaccaattgagtgagagtcagaagatgtgggatctagtggtaggtgggctgtaataaattgtttgacttaggccaggtgtggtggctcacacctataatttcggcactttgggaggctgaggtgggcggatcactggaggccagtttgagaccagcctggccaacatggtgaaatcccatctctactaaaaatacaaaaattagccaggcatggtggcgtgcacctgtagtcccgttacttgggaggctgaggcacaagaatcacttgaacctgggaggctgaggttgcaatgagccaagatctcaccactgcaccccatcctgggcaacacagtaagactctgtctcaaaaatcataataaaataagataaatagattgacctgaaaagggctttgtttctaatccccctggggttcccaaaactttttaaggtagggaagaaaactggggttagaccaattaatctcaaagtttcatccagtaattacagattcagtgatgactgttgttctttagttaacctcagaaaatctgtgaggtaggccccacgtgggttaagcacagttgcactccttgggcaggaggaggtagtggctgtttaaagacctagagattaatgaaataattactctgcctgcacctcttttctcatccctaaaagggaggactgcttttctgtacttcccaggaatgccgtgaatcgagtacgtacaactgtgttgtttttgaacgctgaaagccaaggtaataattagaaagtgtggatgtcacacttattttataaacactctttaaatggatacatgagttagtgtttgcttgatgttgcgaagcaagctgcagtttttgtctactcttcaccccacctaagaatctagttttcagcattaggcaaatgcttctggtacaagcatgtattaaaatttaaaatctgttaatgggttttaagtaggatcttgatgtttggcagaagtatcaataacatcggcgcctaaaataaatattaagttgtaattttaaagcttctattgtcatatttggacagatagatactgtgcagatacagtatgtggaagcattttaaggaatttcagttctagaaaggctctttaaaggtcaacctaattaaagcaatgtttttgagccagtacaaagtagatgcaattattggaaattcattgcaacagcacggaatggcatttcacttacagtttaaactttttatggttaatttagaaagcaaaaatcatcttttttggggggttcctgatctctgacttaaatgacattttaatcaataataatgatttctttgttaggattaggagaacttttgttctccgggatacatggcaggaatatttagcagctctattttagaacccctaaagaagatggttcttttgtaatgcaagtgctgatctaactcagtaaaggaaatgggcttctcacgtagaaggtgatatgcatggacatttatttaccattgtctgtccatagattgtggaatgaattggcttgtgtggaaaatacagaatgacctatccctggatcccagacagagttttggatactacaggttgtctctgcaaggaaggttacccagctcccttaaaatcattctataggaagttcccctccatgcttcttcatgcagtttaactctaatacctaaaaagaagagttgttctttccccttgatgtcacatcctctgtgtatattaagagtttaacttaaaaatgttacccatttcattagattgcttgagtatgatctgtaactaccccgtatacttcacagactaggtcctcagaagtcctctgcattttcacataaactaaaaacctccagtggtggtgttcacttgtctatgtgtgaagtagggacatcatgcattcctgatggacctcactaatgtggcaaggcttgtttgaaaaaaagaagaaaaaaaggccatgcttctaatgagaaataattattggaagcaataaaatatttatattccattcattaaacacactgaccacgaggaaattaaaaagtattgaattccaaaactatcacaaatacagaaaatatacatgaatgtttaaattttcatttaatgatgaaatgaagatcacattcttcacccttagcaatgctaatcacgtgtcactggttgaaatagtgatcaaataaatgagaaaaagatgaatgactttcccaaaatgttagacctatatttagatataatttaccattttgtaccataacctattacttattttagcaaagtcccaatccactgattattgtcgcattgtgtcatactcttcaaaaaaatgaaaagtccatctgacaatatgatatcttagaaagtcattgtaaaaatctgcttcagtcaaaaaaggttttatgattgcatattaactttgaaattaatcaacaagttgacagtagacagtctctagtgtctctaaatatatggcatgtctttgccataaaatagaaattgctacctacagatattatctgaggcattattttgccttgcggagggtatctgttatgttagagaagtgatttctaaacaaactttggctttgccaaagtgtcatgctgtttgtattttctttggtatgtcacaagtcatcccaacatttccctctcatttctttctttttctttcttctttttctccctaaaactgaaggagatgggtcattttgaagatagaaaagatattacggtggccctattttctaagggactttcaatactccataatatgacagcctaagcttctctagcagaaaaggccgcctgggtgcatcagttaagttacagatcctactctgctttctctggcaatggaggaggcaggtgattgcctaaacacaaagctcctgccaatttctgaaaggcacagtggctggagcaaaaagcaactcatcttcccaggggcctgccctattctgaacatctctaaactaaaatgattcttcttttcttttttcttgatcagtcttcagtcactatttttatatcatgaagtgttaccgggtttatgtgcctgtccacatttcataaagttagaggacatatggtaaaaatctaagaataacatcataaatcatccatgcctctgaattgcttgaaaatgttaaatgccttggttttggtccagatgttcaacttgccccttttataccagcctgacatacatcagttgaaagaagaaaaaaaaaaagagaaaaccctctgctgttctctttcagcttaatggttgatatatttttctttcttctctgactttgccatttattgaagcatagacgggtgccctaccctacatgaaagctatttcctactgcttgtgaaagaaaaaaaatatgaaataaacacttactattctgttacaaggtaacaatagagtgctaattgctgagtaaagtcatgtagccccaggattatgttgagggactccactataaatttgaagacacccataatccatgtatcaggcagaaaatgatttgctgtgctgcacttctcctttaacagtttctatcgaactatttaattaaatggaataataattattattccctgatccaaattagaacactttcttgtttaacgttcctagtaagtgcacaataaatattaatgttaatggtgatgatgatggtgttgatgtgttttatggtaagaaccaagaattatgggagcacagaaggtggatgacttttcccttttgggcaggagcagtcaggaaagaattcacagaggcggtaatatttgaagtggtctttgaagtatcagtatttctatatcactaggtgattcttgagatgaagataagtgtttttgatgcattaagcacagtccacagttgcagttgtcactgtttttaggtctttctaccttgaggatttcccagttctcaattttcatgttctgtttgtttctgtataattttgtggagttgggcacttgtatgttaaaaaaaaaaaaaaaaaggtcaggttaacatataatatgctctgctatttccacttttgatatttgctttcttctctcatgttggttgtgtgctgaccatgcactgactcattatctgtcaatgctcagttcttatacagtgttaaggcaccagctgaattaacacaaaaagaaaatgacagagctcagcagggcgcggtggctcacgcctgtaatcccagcactttgggagactgaggcgggtggatcacgaagtcaaaagatcgagaccatcctggccaacatggtgaaactccgtctctactaaaaatacaaaaattagccaggcatagtggagcacacctgtagtcccagctacttgggaggctgaggcaggagaatcacttgaacccgggaggcagaggttgcagtgagccgagattgcgccactgcactgcagcctggcgatagagcgagattccatctcaaggaaaaaaaaaaaaaaaagaaaatgacagagctcttttcattccaagtttttagataccatatccagttgttgttgaacatgatggcattattagtgttttcagtagctcctctccctaataggaaggaagcaaatgggttgcattgaactctctttaatatgagtgctatcttcagcagtgcttcattatacaaagtattaatagaatgactggccatgcctgcaatcctcagtcattttctctagcttcctcacccacacacaggttgttaagtcaccaagagatgtgttacttctgtgctgtgccctgtgaaagctttcctctctagagatctggtatcttcacaggaaaggtcaaataggtttcattgtctttgcacagtatcacactaatttaagatttgagtttcttttaaaaaacacagctgtgagagagagagagctcctctgaagctgagacagtaaaactgaagatacccggaatatttataacatatgtttgcataaagcaagcttgtccaacctgtgacctgtggaccgcatgtggccaaggatagctttgaatgcagcccagtataaatttgtaaactttcttaaaacatgatttttttgtgattatttttttttaacctcatcagttattgttagtgttagtgtattttatgtgtggcgccagacaattcctcttcgtccagtgcgacccagggaagccaaaagattggacactcctggatgaggcatttttaaaaagcagataaaataccaatgtaaagatttatttttccaaaagagtggattaaaagaaagacaagtgctaacaactgttgttgtcacctcatggttttttcagttgtctgtatgagatggcatcgttactgactcttgcaatatttggaataatataaactaagtaccacagtgtagtttgaggcttgagttctataaatacccatttcattaatttggggaggagaaatagatgcgacaaatgggcccaacatacattggctcaacaaaatagaatttatttctcaagttcataaaaatcctgggtggtttcatgtgcgggggaaggagagagtcctctgatccacagttattcggggatgcaggcactgctgtttcagtatgggccttcccaaattctggacatcaccattccattcctcaggatgggggaaagaacccatagcagcttgtgagaggacagtcctggctgtgctataccttatttccactcacactggttagaagtcagtcccattgcgttttttggccatgcacaggggactggggaatatagtccagcttagtgccctggaaaacgggagaaagtggaccttaatggacaggtagcaatctctgctactctcattcatttattttttattcaacatgttttggaacaacctatttgttagagactgtgctaggtgcttggtttatcatttcattagcccactggcctccccgtagtacttcagggaaacagctaattaatttgtgtctctcatgagataaatgagactccagatctaactaaaacacataggaaacttgacatttcaagcttagctcctttttttttttgaagaaggattacaaataatctggtggtagcattatttttttttctcccttgtgaatcagccataggaagaggagaatttgtgttgtcattcttatttgtattctgtaagaatgcttccctttactactggtattagaggaatgtaataccaataccaatatcactatcaattagaggattataccatagtttcataatcttttcaatgtaaggtagtttaatcagtcaccatccacacttcaacaattttccttttcattgccatgtaggttaaatgaagtcaaatacaatgctcgtgtctcttgtattgcccattcattgcctagcatgtttacctatacaataggcatatgatagtcttttaaatatggaataacaacacaagcagcataaaagattgagacagttttctaataatcacaacatatatcccattttttcttttatttcacttttctttttttcttttcctttcctttttttgaatttctttttcctgcctacctttttccgtttcctttttttttcttctgtttttaagctttaccctgcagatggttaccaatatgattaaaattcttcaagaagcatgcagatctgcctattatagaagggaaaactataaggttacagattctgggtactgatcccactctggccactaacttctgatagtaccttggatagataactttattaattgaggtggttgacctcaatatcctaatgtaaaagatgaagatattgcatccggagtaccacaggcctcttttgtcttttttatataactgctatgttagtataaattgttatttatgagcattagatgagtatttataaaatatgtcagggataggagatatcatttgttgttaaaatcttatttttgaaattagactgcaagaatttgaatctgttgtcatgactttttcaggctatttgatcttgggaacattatataacctctcaaagtgacagtttcctcatttgcttaaactactgtgggttataagaatatcatcatggccgggcgcggtggctcacgcctgtaatcctagcacttttggaggccgaggtgggcggattatctgaggtggggagttcgagaccaacctgacaaacatggagaaaccccatctctaggaaaaatacaaaaaaattagctgggcatggtggcacatgcatgtaatcccagctactcgggaggctgagaccggagaatcgcttgaacccaggagatggaggttgcggtgagctgagatcgcaccattgcattccagcttggtcaacaagagtgaaactccatctcaaaaaaaaaaaaaaaaaatcatagggttttggtgataatttaattagatactgtgtctcttggtataagctctcaataactttgatcatctgaaataaaaatgtcattctctttcctctatccattgtgttttcacagaagttagggaaaatgggatgagaattttccaaagcagcccttcctttttatgtaaaatttagatattggcagcgtatctcagcctcaatggtaacattagggtttgcatctctgttgttagtccaggaatctgtttttctcttttgattctttaagtcatttggataaaatattaaagagcactaagatctgatgttgtagattggaaagaggaaatagttgaagaacatgaaatgtgtctattttacctttatatagctatgcagaacaggtgagatttggtatgaatttgaatagtaacgatgcttaccactcttgaaggatattttgcaaattttaattggtttatctgaacaccacttttaggggctaagtaaatattcccactttacactgagtagatctaacaaaatgatcagtttacccaggtcatttactacattgactattgccaaattcagtatatccagattggacttgctgatcatgcatgcttagtgggtttctttttttttttttccattcttatcctattttacataagaacgaataacttattctctctagagtttgtagcttcatttgcaaaaggggatgcctaagagaggaaagagcaaactaggtgtctttctagcttcaaagattgttattttgtgatttctgtattagttggtttataattgaccagatcaatttgaatcatatgtgtttttctattttctgaattcaacactgttattttctattgtcttgagtactgatgtttccaaatttttaaacctttcccttcttttgttttgttttgtttttttcttccttttttttttggagacagagtcttggtcagtcgcccaggctggagtgcagtggcacaatctcggctcactgcaacctctgccttctgggttcccgccattctcctgcctcagcctcctgagtagctgggactacaggcgcccgccaccacacccggctaatttttttgtatttttagtagagatggggtttcaccatgttagccaggatggtctcgatctcctgacctcgtgatccacccgcctcggcctcccaaagtgctgggattacaggcgtgagccactgcgcctggccttgttttgttttttctagagagaaatgggccccaatatttgccttataatactttgtaccttgtcctacatttcccccttagaacaatgtacagaacagtcaacatgacaatcagatcaagtttcaccttctgcacttaggtctcttacttagctatcactagtctggaggtgttgggaacataacttaaactctttgaactatagtgttctgtaatgtggcattaataaatctgaagtcaaaagatataaaatatgtaaaagcgcttaggagaatatctggcacataatgcatggtagtttttcccttctaagtctgtaggttaagatgaatatttgaagactttcaaactgattttcttccaattaaaatatttgtaaatgatgtataaaaagtctccattctttaacaaaggctgttaaaggctctggtactgttttgattatataaattaaaaaattatgtatttcttataaaatattgcatattttaaaaatgtttttagctcattgaaaatattcagaaaacatatattttaatatcttagcccagaatttgaaatttttctatgaaggtgcaaggttctaagaccaaattgtctctgtagagctgtgtaaaattaaaaaaataaaatttcgaactggccagaaaatgtattgttcttcccaaatcttgagacaaaggcacaaaccctgtttcattcacacacaaaaaataattttgatttgcttagggacataagatttatggctctgtgatgtctgctagagatatgtttaaagtggaccactctatacagctttatataaaaaacatggtatacaccttactgaacattcttttcttacattttcttcctatcgtgattttttttttttttttgagatggagtcttgctctgtcacccaggctggagtgcagtggcgcgatctcagctcactgcaacctctgccccccgggttcaagcgattctcctgcctcagcctcccgagtagctgggattacaggcgcgctgtaatttttgtacttttagtagagactgggtttcaccatcttggccaggctggtcttgaactcctgacctcatgatccacccgcctcggcctcccaaagtgctgggattgcaggcatgagccactgcgtccggccctattgtgatttgttagtctgagtttagattacttacaccaggaggcattttttagcctaaatctgtaatcagttaaacaggaacactttctaaaaaattctagttcctaaaaggcttgacttctacttttattctgctcatttatgtgactggctatttgagtttgaattactggtacattaggaacgaaaataaggaatgcttccttttgcttccagattagacaatataccctgttaggtatgccagtgctgtgagttaaactgagctgtaaagtacaggaagggtagcattgtctgacagaactggaaaatgatggattaaaagtaagataaaggccaggcctggtggctcatgcctgtaaccccagcacttcgggaggccgaggcgggcggatcacctgaggtcaggagttcgagaccagcctggccaacatggtgaaacccccatctctactaaaaatacaaaaattagctgggcatggtggcaggcgcctgtaattccagctactggggaggctgaggcaggagaattgcttgaactcgggaggcggaggttgcagtgagccgagattgtgccactgcactccagcctgggtgacaacagcgaaaatccatctcaaaaaaaaaaaaaagtaagataaatagcttcattgacaattgaggaccttaatatgtctgacattaattttaaaagtccaaggaggcaatatattatgtagtatttcccagacttatatgagcatataacttaactcacagaataatgataatcttatccaattacctatccagcatgtgaatcctttttataatacgcttgccttatatttatccaacctctgtttaaatatctacagtaatgagtaaccatttatagtgatgatgatgatgatgaaagtgagaatgataatggctaagtagtgctttcttcctttatactttctatgcacagttttaactgccttaatcttcccacaaccctttgaagtacgtactatttattttttccatttcacggttgagaaaattgaggcctggagggattaggtaaattgtcccaggtaacacagcacaaatgggtctgggtcctagggaatcttgtcaagaatccataaatgtaacgacagcactattttctctctctctccttctgctccctctccctctctccccctctccctctccgccactctctcttcccccatttccctttgcctcccttcctctccctatccttccctttctttccctccctctccttcttctgtctctccctcttctctcttctccctctcctctcttctccctctcctctcccttccctctccctttctttcctctcttctccctctgtctccctctcctctctccctatctcactccatatatatataaattctgtatacagttactccttgacttgtgttctaataaacccattgtaaagccacaaaattataagtcaaaccattaagttggagaccttctgtgtatgtatatatcacaaccatttgatacctatgactgactgtaataactataattaaaaatgtattcacatctctaattcacccttgaaaaaattatattctctgaagttggcttttctgctgggagaataagattagggcctactttatacggttgttgggtgaatcaaataagctaatgaattgagcttacagcatgtagccgtgtgcatcataaggactcagtaacctttaattgctatcattattattaacatcattaatatgttgttgtacaggaacaagcctaaacgtaggccctggtgtactgatggacctgcttaagttcactacttctgagcacctggagggcaaatgctatgaatcctggcttaagttgctttagtctagccgtggcatgcttccaccaaagttctcatcttaccatcttacctcttccaaagtcgcctaattactcgcagcacataaatccgcctgttagattaaattgtggggaaaaagcaagggaaactgcttagatttaatgttagagaatgccaagaagagacatatttattatgcttattttaatggttttctaacacaatagattgggaaatcatgagtttgtcaaaaacaaatcttaagtcatggtgaattgcaaatgcccagctaaatcaggacttaaaattactccctttgtggaaatctctttttcttctatgacacctgaataggactctcacatctcccatgctcttagcccagctattcaggcagctctcacatgtaaatttgtccctggctcctacaccagtaacaactcaatgtgtgcgtgtgtgtgtgtgtgtgtgtgtgtgtgttcatgttacctctacattatatccttggtttctaagtagaaggactaatttttacctatctttttttaacctatttttgcagatttttcttttttgttagtgcactgccttaagcaatattcttttttaaaacattggtttcatatagccccttctacagtggttgacgttcaaactcatttggcttgaaagtcattgttggttttactgcctccattcagatcctccttttctctcttgcttcgcctcttactcttccttcctaactggtctattctggtattacccagaacaaataaattacattgctgatatcagagtgacctgttaaaagtataaacatatcattttctactttaaaccataatccataactcatatcaacaaggttaatcccaaactctttttaaaaataatctgtctactactcaactttctactcagttttttattttttatttttatttctacactttttatttctacagtaatatcaaatcacttaaaactctcccaacaaacaatacctgtttatagttttgtttatattactcttgttgcactgaataacctattagcatacttaaggcagagtctttgtccttttctccactattacctgagcaatattcctggtgtcttgttcatagcagatgcttgtattagtttcttaggactgccacagcaaagtaccatacacagggtgacttaaaatgacagaagtttattctctcacacttctagaggccagaagtccaaaatcaggtgttggtagggctgtgctccgtctgtaacctctaggggagggtcgcatctctcagcttctgttagccccagttgttctgcagcttgtgggagcataactccaagctcatctctcatcctccatcttcacatgctgcattccctgtatgcctgtgtgttcaaattttttcctcttctcataaggacataagtcttattggatatgacctatcctaatgaactcatcttaacttggttacatttgcaaagaccctgcttccaaataaggtcacattcacacgtaccaggggtcaagacttcaacacatctttttagcgacacaattcaacccataacaatgttccatcaatatttgataaatgaatgaatacatgcattctcactcagcagtcgctcccgagaatccttctttttatgttcagaagagaggttatcaccccaccttcattttataggaattacgtcttactataccttgcacacactacttattaattttcatgtcacagtatatttgttcatatatctatgacattggttagattaggaattcctcaagtaagggcctatatattatttatcttcatatctcattgccttacatggttcccagaagggaaaaatgagtgcttattgaactcaaacattctctgaattcaaactctgaattcaaacatttgcttgaattctgactggattattttccttccccacctcaaaattgcattgctgtctgcttgacctttgtgtgacagtagaatggccaggtggtaaagttgcagtattgagacatacaacccatagtttttctgtctgggcctgttttactgtaatcacttcagacaacaaagaatgctttccccatctggggccagttcccctaactagcaaaatcctagaatgccaatagctgggtttcttggaattagtttaaatcattgtttgcaatatgtgtttacattgcattgaaaatatttgttggaaaagatgttttcatttttagcagtcatttttggagacgtttatgtaagagaagcaaatatcacatgtttgaagctagaaaatttctaaggagtacatgaaaattgcaaagcaatttctgtttgtagcttttagatttaaaaagtgatggctaagggcacattttcctctttagaaacgaaagggaaacatttcaacgaattattaagtattacataagtcttttaaaattatttgagatgagttataactgaaacatatacatagggtagttagtgataaattgagaaatgcaaaaatttaattgagcattggagataattattgcagatatttgagataagatgtagctgcaactaagcgcattcaatttagagattatagaaatcatgcatgtggcaaacccgtgaacctctgtttctctccatctgttggctttgcatctttacttcaggaagactacctaaagggaagaaatagaagttagagttttgaacttgctaaccataagtcgtgtgacttccaatatcagttatagtctactatagtaataaataaatattcattttgtgtgtcatctggaattactcaaatttataaaacttatctgatagtaaatatacaataatttaaatgaatgaaatattgaaaaatatctaaagttacttagatgtgacacagtctattttgctgtatatctcttaaaaatgcttttggtaatgcaagggttctttacaaagtattgtctttgtgaagcagttggcaaatcacttattaaatatttaacctgatgagttagttttattattcttaaggcaaatctttattaagagtaaaaagaacatttaaaaaataagtgtacagcacttgctactactgtgaatttattttttatcaaaagaagtatgattttgtattattttgttttgactatgatgttacataataatggcatccttcttcatttatgcagttggcttttttattgtttaagaaatttgtttatattactatttggttacttaatacatagaagaatatttaataatagagacatttgaaaaatataaaaattataaggaatataatgatcataaacctaaagatagctggatgaaattcactttgattttcatttctaagctcttttccaaaaagccaattttcaaagcaggttttcttgttttattttgctgtttttcctgcaagagttgagacactggttttaagggatacacttccattattcttcattatttcttatgttccacccattatacgtgaactatgtgtatcattagaagacagaaaacaaagagctggtcttcccaagaataaagtgtgaatcaaattgattttaaaattgctctgtgccatgcaagctgtgaagttctagaagagtacagtcagcgtcttggaaaagcctgtgtaaaataatattttggatccattgttttggttttcacacagtgacttaagtgtggcattataatttaagtggaaggcttttattggaaatttagcttagtagagctagattaacaatatatgaaattaaaaaatttatgttttggcagcaatttttgtgttttgtctgcagaaggtccttcaagtggggaagtttcatgctgaaagagccagtacaaactatttctgatgagctgtagatacatttgctaaaaaattttcagttattattgctctaatatgctaaatacatgttaaatctgtttctcataatttaaatgttctggatacaaaaatgcttaagaagtaagtatatcagaactgttttcttctgggatcaatgcattgccattctcagtggatgaagagctgagatttgggataccatgttgcaaatagaggagcccacactggcctcccttcctctactctggccacaccttgctattaattactcgaggataagctaaattatttcattcctttgctttctctcagaataaaatccacactccttgctatggcctgcatagtcttatttagaaatctacctaaccaatggctgggcacagaggcttacgcctgtaatcacagcaatttgggaggccgaggcaggcagatcactggaggtcaggagtttaagaccaaccgggccaatgtgacaaaactctgtctctgctaaaaatatagaaattagcctgggatggtggcatgcatctgcaatcccagctacttgggaggctgaggcaggagaatcgcttcaacctgggaggtagaggttgcagtgaaccgagatctcaccactgcactccagcatgggcaacagagctagattctgtctcaaacaaaaaacaaacaaacaaacgaaaaccaggccaggcgcagtgtctcacgcctgtaatcccagcactttgggaggccggggtgggtagatcacctaaggtcaggagttcgagaccagcctggccaacatggtgaaaccctgtctctgctaaaaatacaaaaaaaattagccaggcgtggtggtgtgtgcctgtaatcccagctactccggaggctgaggcaggagaatctcttgaacctgggagggggaggttgcagtgagctgagatcgcaccactgcactccagcctgggcgacagagtgagactccatctcaaaaaaaaaagccacctaagcaacctaattttaactcttgccactcattcctgcatgttgtgcctccaaagaatacccttttcaccgtgatctatcttcacgtggctgcagccttctcattatgttgttctcggagaaaccttccccgtgatgtatcttcacatggctgcagccttctcattatgttgttctcggagaaaccttccccgtgatgtatcttcacatggctgcagccttctcattatgttgttctcgaagaaaggtgtaactcttcagagaggccttgctttcaactatctttcataaatgatcccagttctactactgatcgccttattttatttttctaatagctcttaccactactgcagtttatcacttgtttgttctttctgttcctccttcattcctctttccttttttcttccttttctttccttttactatggtctatctcccttgagaaaatgaatattccatgagaaaatggatcttatctatctccttcattgatgtatccccattgcctagaaagggaagaacaggaactttacagtgaagaaaaggaacctggcagataccaactgaatcaagtgatcaaaggtagcatgacagtaatgggacagatcattattatgagcttgttgatgggttgcactaagaaaaaaaatttcacggaagtatctaattatgaggaaacatcacacaaagctaaactttacaaaataattgtcctgtaatattgaaaattgtcaagaacataaaagataaagcttgaggaactgttcaagattaaaggagattaaagggacatgtcaagtgtatatgaactatctcagatttgctttggttttaaaggacattactgggacaactggaaaaatatgaatagggtgtttacataataatactatatacatgtttattttcagatgacagttttactgtggttattgaagaaaatttccttgattttaggaaatatacaataaattatttagggttaaataaatgtcatgtctgaaacttactgtcaatgggtttaggaaaaaagagtgtgtgtgtgtgtgtgtgtgtgtgtgtgtgtgtgtacagagggcatagaaattatagaggaaatgtagtaaaatgttaaattttgataatcttggcgaattgaagcatatagtaattatactattattgcaactttctgtaagtctgaaatgatcataaaagttaagaaagatgcacctagttaaagtttctatccattaatatataatcagagggcaaaatagccacacagaagcagcttcaaatactggtgtacattcaatgtgcttactaaaacacatgatatagcattaatgttttacttgtttacaagttgaattgatatgaataccgaagacttgtatttttcctgttgaaataattgtaggtaagctagtagagcttatgggttccacttttagaataacatacaggttaaatattttctatacagctactggttgattaataacctcaataggatttttttccccacctaacttcctttgacgtaaaacaatgtttgcagaattaaagcagttttacaaaagaaataatgttgaccatataaccgagacttcatcaagccactttaatttctaaataatgatgttttatttgtttcttgcacttggaaattttgctcagtgaattgcccgacccaaaccttcaattgaatgtcttttaaatagtttgtactcaaaaatggcattttcttctttcagaaaatattttgttcttcaagtatgtttttgaggttataaaataagagatgcaaagcagaattcataatggttattatctggcataaaattgtaataacaggtgttccttgcagattccaaatagctggactgtaatggggaaccagatttagtttgtaatgggctcagtactgaccttccctgctgcactacctgtgggcatcttgctaacatgataaaatggccagaatccgagaagcacctttgtttatggggttggatacttgccatatcttcaaatataataaccagcatccaatcaaaaatgactgaagcataagagtgaaacagagtgcataataagagtgtgttagagtcatttggtgtgtgctgattttaaactcatttgacatcctgttctctgattaaatccacgcaagccccttttatgactatttttacaactgtactatctcagctctacatggctgagtcattatcaaacaatatatgaagccatgagaaacccagagaaagatggaaaagctttggtattatatgaagaatacaatgaagtagctgtccacagcaataaagtcacagatgaaaaccagatataccagtctagtttattaactcatgttcttctaacatatcccccacacaatatgagtgaactgagccttgtttttttgttgggaagtataataaataaaggatgaaacagacgtgatgtttatatgtaatgccaagttagttagctcaaaatttagattgagaaaaagaactgactacaaaagctttgcattggaaatttacatgacgcagcaagaattctgagctcagagctgcttctcccataaacttttgagaatcaaagactgcccttgatcacaaaaacttaccgtagctagctttttgattttgacccaggaaagctcattgaatgcattctaatgtcccatcagttttggaaaagtggtagtgaagcttcttcgaataggggcttccagtctactctttaaatggggcaaatatggacagcagcataaagcactgagggtgagtttttattcaactcatttcattcaatatgttagaattattgtagctgcttcttatgcatctcagattagaactgaaccatctccaaattgcaccctgctaagcagcgccgagccaagtaaaatgttgctacatgaccccagatcagaaatgctaaatcagatcctgccacactgtctctcagccttcccaaatccacttggctatcttctgtaaggaaaagttagtgtcaagaaagcaaaaacaactttcacgtcatcccctgtgaggctgtctcttcaggaagtctataatcagctgtcctctggtgtagatttggtgattttatgtataaagtcacttagcttgttttctcctggctttagaacctccaacatttcctttgcaatctctgttctccaccttcatatccatcaaattctggtcattaaatgtctctggttggcttcctactcattatgccttgttaccagatgaaaaatatgcacacagtcttcatgttcaaggagaacctctgtagcctctcaatttcttttttttcattttattctattttaaattacacataattgtatatatggggtacagtgtgatcttttgatacatgtgtacattctgaagtgattaaatcaggataattagcatatccacctcctcagatatttatttgcagtgataaaattttaagtcctcttttagctatcttgaaatatacaatgcattattattaactatcgtcagcatgttgtgcaatagaacacaaaagctcattcctcttatttaactaaagctttgtacacttacctgtttctagaactcttgacttacccattctattagtttcctaggactcttgtaacaaagtaccacaaactgggtggcttcaacaataacaatagaacaccaaaactcattcctcctatttaactaaaacttcgtacgtttacctctttctggaactcttgacttcccattatattagtttcttagggctcttgtaacaaagtaccacaaactgagtggcttaaacaacagaaatttatcgtcttacatttctggatgttagaaggccaaaatccaagttggcaggttgattacttctgagagctgtgagccactgttccatcctattcttctaccttcttgtggtttgcctgcgatctttggaatttccttgggttacagcttgttgccttcattttcacatggtgttctgcctgagtgagtacatgtgtctgtctccgcatttcctatttttatgagaataccagtcataatggattagggcacaccctatgaccatatcttaatttaactagttatacctgtaatgaccctatttttaaataggtcacattctgagctgctgaagatttaggatttcatcatttgaattatgagagacacaatttaatgcgtgacactcatcttgccacagtgtcttgaggccttccaccttttaatagcatatggcagatagtaatcagtcattcctttttagtacatttctgttttttacagatgtatatatttctgtctattctactatacttagagaaatattatgtatctttattctagggagatatgcacttaacaaaaatattaatatgtgtgtacgggcctaacaatgtgtgagattatataaagtataataatgaacatttcaaatcatattaccttcttttttaaattatcatccttacataaatcttatgatgttttcaagtatttctgtcttcatcattgaagctatgagaagataagttatatacctaaagagatcaaggaaagataggaaagaatcattgtaagtccactatgctcttcaaataatataatgaccagtatgaactgagataacctttagacagggtagtaggaatcactattgctactacccccatcattgtcactgctcttggtgggtctagatatgttttatatcaattatctgttttaatcctcctaaccctaagagacagctattagttgggtgcaaaagtaattgtggtttttactattacttttaatattattctcatcttacaaataagaaaagtaagactccaatgttggtcagggttatccacgtaaaatcaaacaccagtctattttaatccaaagctcatcaatgaaagctaaattttaggcatattaatgaacatgaatttgcagagtgtgtcgtttaaaaaggaagttgttttttttttaatattgagaatgaaaaaaaggcataatagcatcaatccagagtaaaggaagcccctagaggctgagtaggcagattctagggtttccatgttaacaggaacagtatctgatcagagggacagggctagacctaactgggtgagaagatggaatttcatagatgcactggttcaaagataattgagacttatgtggaaaatctccttttgatctactgctaacccaaagtctcctttattaacagttaatgaaaactgagccctataccacataccaatgtacacatgaaaaaagtgctcacatctttagttacaagagaaatgaagattgaaaccatatggaatgccaatatatatccactgaaatggctgatatgaaagaggctgacagtaacaaatactggcaaggatgtggagcaactagaactctcatgtgttataagtcagggtataaattggtgcaattactttggaaaagggtttgacaggtttataaaaggcttaaacacatctatgctatgactcagccattatgtttattatgtttgtacacaaaggagtttttccaagagaattgaaaacatgtctacaacaaaccttatattagttttttttttttttttttttttgagacaatctcgctctgtcacccagactggagtacagtggcgcaatctcgactgactgcaacctctgcctcctgggttcaagtgattctcctgcctcagcctcccaagtagcttaggttacagacccccaccaccacacccagctaacttttgtattttcggtagacacgggattttaccatgttggccaggctggtcttgaagtgctggcctcaagtcatctgcctgccttggcctcccaaagtgctgggattacaggcatgagccactgcacccagccagaatgttaatagctttattcaaagtagcaaaaatggaaagagcctaggtgttcatcagtaggagaatacataaactgttgtttattcatacagtagaatatgatgcagtggttaaaaatagcaacatgaatgaatcttaatacatggtgagtacaggaagccatacacaaggaaatgcatactgtttgtattcacatacaacaccaggataggggaacataatctatagtgtaataaatgaggtaagccattcttttgggggcaggattttacaaggaaagaatataaggaaactttctagagtgataaaagtattttatatattaataggattatggattgaactatatactttccttttaaatttcaacttttaggatcacatggtacactgtgcaggtttgtcacatgggaatatttcgtgatgctgaggtttgtgttatgatcgatctcatcacccacgcagtgagcatagtactgaataggcagtttttcagtccttgccccactcttttcctctcctctctagtagttccagtgtccattgttcccgtctttatgtccatgtgcacccagcgtctagctcccagttataagtgagtacatgtggtatttggtttttctgttcctgagttaatttgcttagagtaatggcctccaactgtatccatgaatgacatgatgtcattcctttttatggctgtatagtattctatagcagaactataccctttagattgttgcggtttaccatatgtgaagtattgttcaataaaaataatctttaagattatcaagctgtatggcttataggtagctcttgtgttgaagaaactactacatgtgaattcttgtgcttacccacatgctcgtgtaggaatgagcgcaaacacacaggaacaccatataacacatgcatgggaacatattccttatggggctgtttgttgttgttattttttttttttttagacaaagcctcagtgtcgtacaatgacatgatcatggctcactgcagccttgacttcccgagctcaggtgcttctcccacctcagccttctaattagctgggaccacaagcatgcaccatcatgccctgctaattttttgtatttttgtagagattaagttttgtaacgtggcccaggcttgtctcaaactcctgggctcgagccatctgccctccttggccttccaaagtgctgggattacaggcatgagccaaagcgcccagcctagcctgtttttaagtatgaaggataatgagacataaggtagattggacctataatgtcttctcagaaatcatgttaaagacccaccgtatgaaaacagttgggggaatctgcccttttttgcccaaagcagtcctcacattggctttactaccccctccccagcctcccacattttgtactttgctctggacatcctcacgagccagatcctcattgaaaatgagcccctttgaattagctgcttaaaaagatggagctaccatgatgccacaagaaacccagcttgtgcaaaggcagcactaattttaaaactcaagtgttatgtctgggttttttttttttttattaacctctcctagaactcttctgtgctgtcatacataaatcagaagattatgaaagaactagtcaaagtggctgtttccttctaaggctgtaatttggttccatgaattattaattattagactgatatggcatcagctcctcagaacccaatataaatgcaaaagcctcaccttatcagttataatctaaggagctgcagtaatgtcattcttcccatttagtggtgtgttatggggtttaggatattcaacccaacaaacttctgaaataaaatacaaagtaaaggatatttttgtgtgtgacgagatttgaaattcagtataaggaagcagatgtggattgcttcaagggttttgattgttttgaaggatggagttgtttcatagatgctaaagcaaataacagggcatgtaaaagactgtggttgaagaaaactgcctgaaagtaaagctttggaacatcttgcatctctgctgctgttagggaggaaataaataatgcaccatggattgaagttgtgctaaagatacattcagtatatgttgaaagcaaacatctgatatagtaagtatatttttcttatgcgaattacagctcttatattctttgaagcaagaactaaaaacgtattaattttttgtttgtttgttttgctggagtacttagctttaatacttgatgatgcctcccagttttctttggttctgtctttaatatgtaatgtcatgttattttaaaatgttctgaagaaaaaaatttataagcttaaattctgttccgttttgtgagcacaagattagtctccttttaggtgcaagtttttttttttagcagtttctggatattttagaagtgtgctcctcacatatacatacatctgattgtatcaaatacagactacagtatgcagctaatgttgcaaacgccacactgctcagcattgcagtataaagaaggaagtaacacctaagctgtaatgtagccaatggattgggggttctatgaatggaaattctaaccaagtagaaatatatgttggagttagctatgctaaagtaaatgtgttctgtttcactaacttagccattctaagagattatttagaaataattagtttgctaaatctctgcaaactttcatattattcatagaaatttcagtagctttgttactctgagcacactacagcaaccccagtgctctttgacttaaatagattacattttttaacaaattattttatggggttgaatttggtctaagaaaatgaagagtgtattcattctattaaaaaatggctaaatatgaaaatggcttgagtgataaaagtaccttgactatgctctactgtttctatatagtcagttttaagaaactgacaaattaaaaattttctcgaactctctgtaaagttaaaatattaaaagtcgagacagttttcttcattaggcctgagaggcaaaggtgtgatatattagcatttgaaaaataaataacagtgcatcaaaaattatgaaaacttttaagtatgcttaaagaataggatttatatccaaaaagtttcctgaaataaatagattgtgccacataatttatgactcattaaaacaaaaacaaaagatgatatttcttctttagtgtgaaataactcattttctattttaaattaattgctttctataggcaaattaggggcaaatattcatcagaatggcaattacttgaaattttttcatgtttaatatggtactgttttcagttcattaatactattgaccaacagctactataaaaaattaatacttttccaaatttactttctgtatgagagattgattcattatattgccattgaggggaaaaagctatgtagaagtaagtttactatggacaggtttagtcaatactgtgttgagtagactgtgcatgagatatagggtagatttagacctgaattaacagtgcatcagactatgaaattttgttcagtattaaaacaaaattatcttgataagcatctccaaaatcacatttctggcccatcattgttggggtgtataccacggaactgagagttccctgaaacacttggaaatgatcactgatctggacttgatcccaaatgatggggctcattctcctttcaattttgctaacttattttgatctcctgccttcagttttaccagagatttgaattatgtatttggatttgcaataaactatagaatatggaggctcaggcgtttccatatattgatttattacatacatcttaagttttaaattggccaaatcaaaggtagtaggtttaaaacccatatggtaacttaggaatcagacagcatttggggagaagcaacatacagaaaatatcctttggtccaacccagtcattaaaacaagaaagagctattgaactggggaaaaaaagaaagaaaagagaaaaaaataatatcctttaggttagagtgctggctttccccacccaatatctgtgtcagtttctctggggtccctttctgttctggtttgcccttactctgggttagtttagattccttatcaccagccatggtaagccatagtaagcatgttcagcttcctcacttctgtaccctatctagtgtcttatgttatttttgcccctgtaagtttgagccattgtaacttctgtggccatagtttcaagactatgcttatgatgtggatgaaggtgtttttgtttttgttgttgtttgtttctttttctgtgggataccttaggattcattcatttgtgatttcagaatggagtgagagagagctgtttttgaaaataagttatgctaacttactagctgttactagttacataagttctctgagtctctgtttttttctctatttgtaaatgaaaatgttaatattaactatcttatttgattattgtgagaattgaatgagataacacatgtaagatacttggaattcaccctccatatactaaatgctcaataaatctactatgttcgagtatgatatgaggaaggtttatgcttctctaaaaatcactgcaattaattctagtttgggttaataatggatttggtctgttatatggattctaagtggaataactatgaatgttatttaaatgtatatttatatcaatgaagagtgaaaatcaaatggtttcatcattaccagcttaccacataatcatgctgtggtggaaatctacttgtaaagagtaacctctgcatttttcttcagatacaatcaataaatgtgagtgatttcattacttatgaaataattcaggaagaaatataattgtgtgcatcatgtaatataattgaatgtggacagacaaaccaagactaattacgggcttgggttttcccaggaaatatttatgtaagtaacttctataggtggatatcagtcctgtaaggattttgacattcttctgccttcagtaatgcagcactttctcatcttcaagagctagctcatttgtgaagctttcctgtgtaaccctaccacgaaataatatttttctactttaaacaattctagtatcacaaaaccagaagcttgtttctgtgctattttgaaattttctccatttttccataatatatatgtacacacacaaacatacacacacatatgtaaaagaaatatatatatatatgtgggtgggtgtatgtgtgtgtatatgtgtgtggtgtgtgtatgtgtgtgaatatatatatatatatatatatacatatatatatatatatatatatctctttttttccttcttcttaaattttattacaagatattggaatcacatgcttaccatccacccttcctcctgccacttggtggatatttgtatttctgtagatacttaagtaaacaatatagctcagcttcaaaagtcttagttcaacaaatcaaataaaaagatgcaaaatgtaggtttagtaacaagttaatgttctcatgtatgagtaatggtgcaaaagccatgactattataattttttaaatatttgaagtgttgtacctataagcaaagaaactaactttgtggtggcttttatttcaagttttccaatccttactttaaagacatttggattatgctgtgcataataggagaaatactgccctatgttccaactttcaatttctaaatttatttatatattactatatataagtatattattcaaaccccatcacaggtttgaaattaaccctcttggggaacatcataatagttttcttcttagacttcttataggataggtgtgtattgggaaattagcacattacttatttttacacataaataatcacttcattttaattttctgctctgatttccacctttcaggtatgtataccagatactgaaatggctgatcccactttgatcacctgtattacagaattaggttattttccaaatttgacaaaattgcaattaagaattgcttcttagtagactttgcagagtatctgagttacgttctttggatctcatgattttagaaatgtttagagaacattttgttcattccactaatgggaagatagaccccaagaggtttctcaaggtcagagagcctgctagggaaggagtcagacccagaaatcaggtctcctgacttcttgtataatgtcctttttagtgtaccatatttcctcagtcagatcgatctactcgtccctgctgacattcagaaatctcccaggtatttgtagataatgtagctagtggctattttggagcatcagtctagaagttaagataataaaatagagttttcactttattatgtttttgtgtgtaaattatttcacaacttaaagctttatttttttctgtaaaataatcataggtttctaatattttggcttttctagttttctcaaatgacttgattgaagacaatctgagtaattcaagactagagaggcaaacaagaaagaaggaagaattatttcattcttattaggagtgaacagtgcacatggtttgaagttttcatcagggattccgaatctgttgtttctatagctaataatagattgctcttcagataggctgctaaactttgtagaggttaaaactttcaccacacgagtgtggctgtttgttcaccgcagtgcattgccaggtaaactttaaccgaaagctcaagagatttgatattttaatcctacaaaagcaattttgtttgccagcaaagtaatacctggatttttagtttctcagaggagctaggcatagaatttaaaatgtattagagctgcccttggggctaagaacatctgctggactgtagtctaataaaacagaatctgacaaagatgaggtctatgacatgtactctgctacaaccatacttgagtagatcaaacgggttggtttgacaaactgatcaagacaacaggcttatggaaactgcctcactaggacagctatcctcttccttcagggttctgccccaaatctcccttgcagctgaatttaatgggattttatcatatccccaacatgcagtctaagagctgaactcccacctcttttctgtttgacagaatctctcttatgagcttagggataaatattgggacttagaccaaacaaaaattggtgaaatttttggaaaggagatgtagatttaaacttagaattgtcaggttcaagtcttttcctcctccatctctgattttttattttagatttttaagtattatgaattcatagtagtcgtacatattaaaggggtacatgggatattttgaaacaaacatacaatgtgtaattattaaatcagggtaattgggatattcatcacctcaatttcctgtccctccatttatctgtattaggaacatttgaattccactctttcagttattttgaaatatacaataaattattgttaactagtgaccctacttgtgctactgaacactagatctttttccttctatctgtattttcgtactcgtttgccatccctctttatcccaactctgattttatctaagcctctcaatgtgtcttatatctactagtttcttataaaatatagtaatagcaattcccaccttctttatggtacaatgtttttctagggaatttaatatacctaaagtatatgaaagttctttaagcaggttataccttacgcagtacaaattgctgtgattgcaatagttccttgtgtatctcatcttttgaagagaggagtgtattaacttcctggagctgccacaaactgggtggcttaaataacataaatttattgtcttatcgttctggaggctagaagtcagagatcaaggtgtcggcagggttcgtttcttttgaggtctgtgagaatctgtcccatgcctttcttctagctttgggtggtttgatagcaatccttggccttctttgtcttgtatcacgccgagctctgcttaaaccttctctctatatactagtctatgtccaaatttcctccttctaaaggatgccagccatatttgattaggggcctgctctactccagtatgacctcatcccttacactagatataacctcagaattatatctgcagtgaccctatttccaaaaaaggtcacatcctaaggtactgagagttaggacttcaatatattaatgtgaagggggacacagttcaacacataacaaggaacataacattttttttgtctcactgttcttaacttactgctgcttttactcaaaaaatttgggatgaccatgatgtttctggatcttcccgtccctctgtccctgctcttcctgtaaatctcaacctactttctaatatatttcttgtataatctcaaagtacaagaatatgcataccataagataagcactgaataattgtaaatcactcttagtaaattagtagtctaggctaatctgattgtcagctgttaattttgtggtttctgagaatcatcaaataatgtactcaaacctgctgattgtttatatttttttgaactacaaagaactttcatttacagtattacatctaaaccaacatagttaatatttatattcttatcaaagatgtcaaacttcaggtgtagaggtgatgaaatgccaaaagtcacctggctagtaattaatacagcctgaattagattttaagagtttttaatttcaaacctagaattctttctgctctatcattatgctgctctttagaaaatgggtatagtaaggtttgtgacctctgtttgaaacccatggaactacatagtggaccctatgagtacagattgtccatataatactttctcaatttcttcacatcagacatttgtgatttctattatctatccacagtggttattgtgcatgaggctctatagttgacataaatagtgaaaagaattgtttcatttctctgaattgttgttctgcagaaacctcatgtatttgttttctagtgctgctctaatgaattaccacaaatttagtggcttaaaacaacacccatttattagcttacaatatttatggatcagaagtgtaaacacagcatggatctctgcttagggtctcacaaggcctacagcaaggtcgtgacaggcctttccccttcctggagctggaggagaaaatttgttttcagtctcattcaagctgttggcagaatccagcaggatgtgattgtatgattgaggccctcatattttgctggtttttggctggaggtcattctcagctcctagcatctgctcgcataccctggctgctggccctcttcaaagccagaaatgatggtagagttcttctcacattctctctgctctccctttctacctcatctgtcctgcctcaccttctcctccacatatttctgaaggaggctcttctgtcttccccttctgcttttaaggactcatatgattacattgggccaactgattatctagggtaatctccctgttgtaaagtcagctaattaatcaccttaattccatctgcaaagtcccttcacagtaatacttagatcggtatttgatagaataatcagtaaatgggaacctttgagggacagctctagaattcggcctataacatctcagtattttttttctttttgcattaagcattttcaaatcagttctttacccccaaaatcatgttgtttagaatgtactaggtgctttcaacttatgttattcttatggcatctgaatgggatggagacagtcatccccatttcttcgataagaaagtaaaggcaacaagtttaaaaggttttatcagatacacagggagtataatttaaagtatatcagagttcttctcagtgtaaagtacgtctgctagtttttaacataataaaagataacaagcccttattttattctttctgttttaatcatttatgtaattgacttgttctttccatatttcttcccaatgtatgaatcctatgagattatcatccagtttcagagcaggggcaggaattgtttgggggagtaaaaatacatggattaaatgcctagctcttggtcagtatggtacatatatttccaagctttgtttggtgagagagcttgaaattaatgacaacccagtagcaatgagcacacctaggactcatatcttggtatttaaatatcagttcttcaaatgctctttgaagtagctgatttcaaatctggggtagctatagtacaagatgagcctggagcaactttggcactaaaaagttagaaagtcctcaaaaagtaagagtgcatgtcaaaggacataggcactgacatgaaagaacccccaatgaccaaagctgcaaaattggagcaacccaattaataactatagttatttatttaacccatagaataaaatagatatatgcgaacccatactgttatagataggtagatagatagatagatagatagatagatagatagatagataggagtcaaggatcagctcttccttccagaagaattataattaataaatgaattatagaaggaataaaagaaattgaacaccatcatcaaaacactatgttaatggctgggcatggtggcacatgcctctaatcccagtactttgagaggctgaggtgggtgaatcactcgagcttgagagatcaagaccagcctgggcaacatggcaaaatctcatctctacctacaagaaatacacaaattatctgggtgtggtggtgcatgcctgtagtcctagctactcaggaggctgaggtgggaggactgctagagtccgggaggtcaaggttgtagtgagtggagatcacgtcactgaactccagcctagatgacagagtaagagcttatcttaaaaaaaagaaaaaaaacagggaaagagaaaaaaaaaactatggtaataattgttgcagatgagatacactggcatgctaaatcttgtggatgaaagttcaaaaaaaacatttcttactctcaaagtatatcctcccaaaatttattaattataaaggggaaatgttaaatttcacattggaaaaacccagcagataccaccttaatcaagtgatcatgtttaatatcaatggtaagacattttgacatcatgtacccctgacatgacacagtgagaagggcacatcagttctgtggtttcttgtgaaaaatatataacttcaatctcatcatgaggctgcaccaggcaaacctaacatgaaggacactctataaattaacttagcatcattcttcatcgtatcttcatatcacaatacaagaagaggatgttagtgaaaccattggtaaaatccaagtaaagtttatagtttgttccctgttttgataattgcactgtggttatgtaaggtatgaaccttggagaagctgggtgaagagtgtatgggaattctctgtactatttttgtaattttttaaaatataaagtaattttttttaagtctggctctctcattaaatagctttgtaatattgtacaacatacctcttttgagtctcacattgtccatctgtaaagtttgcctaacaatacagagcctgttacaaagtatgtgaaatctaacagagagacaatgtagcctcatagttaaaagcaattgctttgaagtgatataagtgtggttttaccagttaaaactgtggaggaatgcaaaacttacctaactttattaagcctcagtttccccatttttagtactcagatgcacttactgtgaatcttaaatatgatatagcaggtaaacatttaacccttcttagtaggagatgaactgagaatgaggaactacaaatttgaatccaaagtcttaaattccagttgcacttattaggatttttttacatgaagcagatattaaaattaagcatgcaagatatctttcttcgtctaactcacatattgaagtgaacaacttttatttagggagtttttatacaacagcggacaagggaaaatttagctcgtgttattttgaaagtggcaggaataaatgtttgattaataagattacaggcatatttgcatctggagagaaggttcataaaagagttatttttacttgtaatttatttagcttgaaacagagggaaaaaattgagattaatcagttgtcaaataccttctgagaaacccaaatatacttaaagaatcatgctgagatctgacatacttctaggtttttaaaggaattttttttttctttttgtttttgttttggctaatcagtttatgaaccactttgtctatgggtaaaccaagatctgataactctcagaacagaactttcataaatctgtctgtggaaaaatgcctcaaaacatataaaaatcataaaataaagggaacaaatataaagaacactggagagggatttgggtgttgtgtctgtatttttgcagtcttagcttcatgtgctgcctgaccacatacttcgtacttgcttcctcctctgtcatttgagatgttatttggttgtgagaaggtggaaatagcactgtatgttaaaattgattcccaaatgcgtcaaaatgtcgtatctgtggtctgatggacaacaaacaaatgcaatcatgaaaagttattcccatcctgacaagactttaagaaaatccactattttgagaatgggtaagttaaaaaattactacataaaataaatcttcccttcatgtaatattccctatgtgatgagtctaaattgttggcagccatactcctaataatacacgtatgtacatatctgtgtgtgtctatgcacattttaaatacttgtgacatatttatttaaagtttatttatgagcagtatggtagtttaaaaggattatgaaggtcattctgtgtgtcaaacgttgttttaagaagaaagtatctgaaataaagtagcacttatttgttgctttgtttttattctgattgcagacaactgtgtcatacagtatatgaccaagtagatatttttctgtacatcctaagagagggcttggactaggccatttctgtattgatatcctgagacctacatatccctggagaccaattacaaaggttcacaaggttgtttttattttgttttctcttgattcctttttaatgaggtctcccagtaaacagcaagcatgatgctttcctgttggaggcctgtctgccgccttcaaccatttattactaattcatctgggaaatgatttataaattaaatattaggaaaatgtacttgaggaaaaaagtggtaagaggtacaatttataattctcatttaggagaaagtcatgccagcagtttgctaatggaaggatgctgagagtcactcatagaaatacagttgtggtttatgtaataaatagagatgtacatgaagagaatcttcaatgtatatttttgggcatgtgattcattttaataaattgtgaagacagaagttcccaatttttctcttcaagtgaacccttggaaaattgggaaataataaagagcagaagtgacctatcaatatgtgctatctcataactcctcctcatgacaaaaatatagtatttatcaatactaggtgaaaatagcttcatcatagaataaaatgtggtgttagtagatgtcagtgtcatcatagatttgtgcaagaagggattccagatgctattttagaacaatcttctcattgtacagatgatgaaactgaggtcatccctgtttatgacttacctaaggtctcataacttttaagatattaaatttttgagattatttataaagcttcaagatttatttttgcacttgtaggcagtttttgtatgaaagaaatctgcttttcagctaatcagtcagattaggattgtgtcttatgagaatatcttttacatttgcgttgttgaaggaagatgaacaatagctgtgtctctacacccagaattaaagaggaacaaaattatagctttggaatcatcttctaaaattttattaattccagggaattaaagcacactcatcttgcaggttttatttaataaaaacgtttgttactttttttaaagttctgagtaatttctaggtatcttttcttttcttttttttttttttttgagatagtgtctcgctctgtcgcccaggctggagtgcagtggcatgatcttgactcactgcaagctccgcctcccgggttcaggccattctcctgcctcagcctcacgagtagctgggactacaggcgcccgccaccacggctggctagttttttgtatttttagtagagagaaggtttcactgtgttagccaggagggtctcgaattcctgaccttgtgatctgcacgcctcagcctcccaaagtgctgagattacaggcgtgagccactgtgctcggcctctagatatcttttcaatactgctatagtggttgcattatagcaatcattaatctcaaagatataagcagtgaattcataactgtgaaatcataactttgtggttaatatttttttctgatcccattttaatctttttaaaatttcatttctgtttgaatatttagactgtacttgaatataaatttcaaacataattaagcacatgttatctttatttaaaagatgaggcatatgtatattatctatgtatacactatttaaatatgtccatgtatacataaaattatatgttatatgtaattttctaaattatatatatatactgaaacagacagatacagtttatggctgatattttctggtgaaaataatttaccagtatgggtttgttggtgtctggctgtcaccactaagaaaagattctactgggtcattataaaaatttcagtttgggggaatgttaatagaaattagccatattatagtttggacagcacctatatgcagtttcatttaccgatattaacttagcacatgctggtttatgaggggaaacagaattcagtggtgcacatttaatcatttttctttatctaatttaaatcatattcttcttgataaagtgttatcttggccaatgtaagaagatggaggaccctcccatgaactttgtgggacagacactgaaaatctgtgttgacagcatgtctctaactcatccttctcacaacatttgctgttggaatagaacagagaattctgtaagagtcatagtttttagataaagattgttacagaggcataataattccagaagatttccatcttctaacaatctcttgaaatcaataataaagacaatggctttctattcgtccactttaccacatcaggcagtggaaatagaaaatgatataaaattaatcccttctcttgacaattgtaaaatggtaatcctccattttatcctctcagaggatatttgaagataacttttttattatcctattttcatattctgtctcataacctcatatattgtatagcccatttcattgctggtggtcaaataagactgcggtagaaagccacaggtaggttactagggttctgaagaatgtatcagcacagaaaaccaatttcagatatattttcaatgttattgctttagaatacatctcctttactgagacatcaaaaatcaaagactagatgagctcattcatgtgaataagcttggggataaattacctctttctagtttcatattaaaagagcagtagcatagtcagcctgactgtgggatcttggtcaagcaaagctaaatgttcttttcctaatttttcatattatttaagtgtagtgtcagaactattccttagtgtctttgttagttttgctcttaactgtagtctcatgtgttcagaatgagcaccagccaacaaatacagacaaatgcaatatttcaactgtactttacatataaaaagatggtgttaatacactctcttctgtggttattatgtagtttacttacaaactgacatgcatttttctcacttataagtgggagcacgtatgagaacacacagacacagggcaacacacactagggcctatcggggtcaggggcaggatgagggagcacatcaggataaatagctaatgcatgcagggcttaatacttaggtgatggattgataggtgcagcaaaccaccatgatacacatttacttatgtaacaaacctgcacaccctgcacatgtatcccagaacttaatagaaattaagctaaaaagaagaaaaactgatatgcatgatgcatgcttatttcttcagaaatattgagatgtttatttaatagatgccataaagctacctgaaatctaactaagagaatcctagtttactgcatttgttggcaaaaaagtagactattgatataaaatattttgaagttgcagccttacatgattgccctgtttagttttttggaatgtcttttcataaggaagtttgattctttaaacttggaattccaaaattcccagtactttcaatcaatggactaatcgcttccctgcctgctgcctgcctgcctgccttcctccctcctgctctttctttcttcctttcctttataataaaaaatcaagttattggaaaaagtattgagtcactttattctttgtgtcttactatgtaagtttcaaatttttgtgcctttttgcttttattctgtcgttgctgtatttcgaagcatcgttttccccttttccattgagatgtagtatacataatgtaaaaaaccccttaaatattacgtttcatctattgctccatatatgtactcatgtaaccactaccttgatcaagatagagaatatttccattaactttaaaagttctcttttactccttgtctgtcaatacctcttctatcctgaggtaatttgtcttctgacttctatcaccgtagattaattttgcttgttcttggacttcatataggtggaatccaaaagtacgtactgttttatgtctggcttattttgctcaacatactattttttgagattcttttgtattccatgtatcaggagtgtgttcttttcattgctgtatattatgtcattatatgaatatatcgcaatctcttcatcctcctcctagtgatgaatataactgaagcaaatttacaaatactttttttttttttggaggcggagtttcactcttgttgcccaggctggagtgcagtggcgctatctcggctcactgcagcctcctcctcccgggttcaagtgattctcctgcttcagcctcccgagtagctgggattacaggtccccaccaccatgcccagctgattttttgtattgttattggagacggggtttcactatgtcggtcaggctggtctcaaactcctgacctcaggtgatttgccctcctcagcctcccaaagtgctgggattacaggcatgagccaccacacccggcccagtcaacagttctcgtgtcagatgggtgtacccacgtggggttgtggtttgctcttctaattcttatgcaatagtaatgagtctttaaaacaaaatcctgtgtttgaatgttcttgaaatctcagaaattatctagcaaataacagggcttttttttttcactgcatgtgtgcatcatacgtatatacctttgtaactgaaaacaaaaggtagaatcgtatagtagttaggatagaaagctgtagaatcagattgcctgaatttgaattacagatattctacttgatattgtgtgagttgaggcaatttatttatattagctgtatcttgctttttaaaaaataaaaaaggatattagaaccttcctcatagaattgttttggtgattaagttagactttaccttcagagtagacagtaagcactcaataaatgttaactgttattgttccaagtatgtacattatttttattcaaaaatgtgtgcaggattccatatgattctacaggattccatatgattctacatacatatgcatcgttaaaatgtactatgtagattaggttgatctaatgactgtcttctctaaccaaaattgtcagagggctaactcttctcactcattttggctcttgtatctctactttagtggaaccaaagtgaatgataacaaccagagagagattgcttcttgactacaaataatgagatactccagtttaaattagttcaacaatgttcttgatcaaatcattctcaatcacttattttcagaatccagatattactgctgtgaataacaaaagaaaactcaaatttctgttcttgaagcattaagcctcttgatattgggaaaatggtgttaagtgtgaaagaaagacagccatctaatttgttggacatctaggtgtgtcatgctaaattctttagatttgaaaaataaatttttcatagtatttttctattctgaaaatatttttatataaaccatgatttctttttttttttgagacggagtctccctttgttgcccaggctgaagggcagtggcgtgatctcggctcactacaacctccacctctcaggttcaagtgattctcctgcctcagcctcccaagtagctgggattacaggcacacaccacaacacacagctaatttttgtatttttagtagagacggggtttcaccatgttggccaggctttggaactcctgacctcaagtgatccacctgcctcggcctcccaaagtgctgggattacaggcatgagccactgcgcccggcccatgatttttaaaataacaaatttaaattatttttctgactacctaccatttatagctgtaagtgtggattctttcagttaaatatttaacgtgtttggtgccaacaactcagtatttagcctaatccctatttcagaatccagagtctatattggtgccattcgttgaataccgaggatggcacagagctaaacctccatcaccccatagacagtggggacagtgcctccagcatacgaatgatataggtagagatatggctgcaaaatggtagatgtgactttctgacttgagggatttcagggttttctaacaatgtaggatggtgggtagataccaaaggtccatggctttcatagaccagtgatgatacttgaattatttatgtaagtgtttcatccctcctattaaactgcaccttctttgggagtaaattttaggtattaatttgtttcttctacaccatttagcatattgcgtgcgcttagtagatcccacataaaaatttctcattaaatgaagtaagcatataagcctaaaaagtacagtgaaattttttaaaaatgccattttaaaagaatatgacaacaaaaatggcatatgtatgcattaaataaatatgtaaaatgactctcaataaaatgttaattgtgtagttatttttggctgggaattcaagtgattaaaacttctcttttttgtaattatatcacttgttaatagtaattgatattatttatattatcagaaacaaatgaatatgatcatagtagattataaaggaaaacataaacaaaccattaactgtagaaaaatcaaaattttcaaagctacttttcccaaaattatcatacctagacattcaaggagttgattttgttttgtatttaaatttttctatagtatggagaaagaaggaatattcaaaattatttttataaagccaccattacattaatacaaagatctgccaaacacagcccaaaagaatatttcagatcaattatacttaagaatatatgttcaagaatcctaatttaattcatcagattatttgtacattaaaggaaaagcacatagaaagaaaataaacattgagtgagcctcgttgcaaaactcttctgatatttcaaaattgggaagcagtttcctttccatgtaaatcattatttccaatatattaagtataatacaagtgtaggtttaatcaatttctattttggtaactcatttaagagcatcactattttttatactgtggatgaggtattctgacttctcagttgccttaaaagagtgccagggagtcatactgcagtgttaaatgtgctcttctgccttgcattcatgctaagaaaaccagtgtctattatgtggctcctcgctttagccttctcagcatgaatgaccattcaaggagcaacagtattttataaaagtattgattgtgttggtttgtaaagggccccataatgttcttcccacatcaaacctgtgctctctgtgtaagagaaccataatagctacagcctcctggtaatgtatatgaattgtacagaatttcagtttatggatcagctttgtaatagtgcagagtttcacttggcttaaccaggtgtgggcaattgttgggtgcctttaaaaagtcataacatttccagggacagggatgtaatgggtcattttataagaaagaagaaaatgtattaaacgtaccacattatttttagttcaatggtaggtgtaagacagaaagtacgtttgcttggtatacatttctgtgggacccagtgtttggctttggtctgctaatttcctttgccttttcctatttaagtttttttcttttattcttctattaataatatgatttctataagtttcagaaactttctaaacaataaagtactccatttctgcactattgaggttgatgttggccttatttattctcaccttttttttaaatttggtttttgatttgggatttggggtggcgctggcttattagcgttcttggttgcagcacattttcctccttcagtaacaactctagaagcttaataaccaaagttataacctacatttgttttactgtgctctaatactcttaactaccgggcagatttcagtataaggtgaattggcatgagaattgtttagtcaatcaatagccatttaataagcatttggttacatgttttggaatttttaagagacatataagatactagtgtgccatgttctcacagagtgaacaatctagggaagcaagaaatatatatatatatatgacaatggttttaggtaataaaatagaacttttaaaataagttataagcttatttcctcatagtgatcattccatatcacaggccacctgcatcctccataaaagaataggattcttaaatttgatgtttaatagattgtgtcactttacattagccctaattaactttttcctagtaattttgtgaccttcaaaatttacttaatttatcaatgccattagtttttcatttttaaattggagatagtaggaatatctgcgttatataacatatgtaaaatgtaatttaaatatacagaaatgaaaattgggaggtaatctaaccatcttgtgttacatatgaggaaatcaacacactgaagtaggaggcttccccaaaatggaatattgagcttcattagtggatattacatttgttgactcttcatgtttcctcattggagtttccagatgccactcttgcttctgaaaatcgtgtatgacttgtgatgtaacaaaaatcagagggctttccagtgtcgcaactttcttttttttaggacggagtctctgtctgtcgcccaggctggagtgcagtggtgtgatctcagctcactgcaagctctgcctctcgggttcccgccattctcctgcctcagcctcccgagtagctgggactacaggcgcctgcaacctcgcccggctaatttttttgtatttttagtagagacggggtttcaccatgttagccaggatggcctcgagctcctgaccttgtgatccacctgcctcagcctcccaaagtgctgggattacacgcgtgagccaccgcgcccggcccagtgtcgcaactttctatggtataagagttactttgtttagcagaagtctcacagtttgagaattaaccttctcagtggagagctggcagactggttataaataagggcttcagctcccttagtgtgggacatgctgcccgctcccttcaggtacttatctgtcctggaccagacagaagcacatctgcttttcatttagcttacttccatttctccacttcctctcttttgtcagtgttaaagcttaaaatgatgaaacaatccagcagttatccaactacagataaataactgctggactgtatcatcgtagacagttggtgaaaaattctagaccagaatccagtcccttcagtcttgtattctttctaatgtattgagaacaagacaggaacattgattacctatttttagctggtttcaaaaacagtaacctcaattccacaatcaagatttggattcagaaatactgagtttgcactgagctctttcctgcttcactttggggtcatgagaaaggctgtgaatttctgcttcattccgattccctcattttaataacctgccaggagacctctaggggagtgattgtaataaactagctaataaaatgagattagaaccttcaaaactaaacatcctcttatgatacaatccagcaatcacactccttgagatttacccgaaggaggtgaaaacttatgtttacataaagacctgcacactgatgtttctagcagctttattcacaattgccaaaacttggaagcaaccaagatgtccttcagtagatgaatggttaagtaaactgtggtacacctagagaatggaataatatttggcactaaaaagaaatgagctatcaagccatgaaaagacatagaagaaacttaaatgtgtattactaagtgaaaaagccaatctgggaaaaaagctatatactttattattccaactatatgacattctggaaaaggtagaatgactatgggaagagtaaaaagatccgtggttgccagggatttggggtgatggagagattaatagagcacagaggatttttacggcagtgaaactaatctatatgatactataatgatagatacagatacatgttattacaaatttttccaaaaccatagagtgtaaaacataagagtaaaccctaatgtaaactccggactctgggtgataatgatatgtcaatgtgggttcactgatgataataaatataccgctggtgaggtatattgatagttcagagaggctgtgtgtataggagggcaggcatatatggaaaatctctgcaccttcccctcaattttgctgtgaacctaaagctgcctagaaaaaataaagtctgttaaaaaatcaccacagaggcaaaatgtgagattagaacaacctcttcaaaataatacacagaaagtatttacaaatgctaactaagacatagggttcaaaacgtaaaactgctcacagcccaggtactaaaattagatcaatctaatcattagatactcaatcattagatacaatagaatttgccccagtagcaaatgtttacttttgattctgttatacactacttaacatggtccagtgtcagcataaggctgtaatttggcgattgcatttctttatttaataactgctgataaagctgaaataaagaatcagtaaaaaggtttcacttttgtaaagcacatccagggtttataggaaaggaaatatttcagcatttctgatatataaaagaacaaaggtgttatattaagaaaaaataatacataaaacaatatcagggacattgaattgatgaaagtaatcagtaacattttaaatccatgttggcttgcattgtgaaagaagggaataatttacagttcatgatatttgtatttagatgtttgtatttttattgtgtttagagaatcccaggaaaggaaagaatcctacaacccgtaggatgaaaaaagctttggatctcatgccaggacaagggcactgatgcccaaaaagataaaggccttcctcagaatcttatgggaaaagtcaaattatttaaaattagctccagggttcatgagtaagattaattggtagaagttaaatggctatatggttcacgtttaaaaataatttctaaaaattggataccccttatgagagaaaatataagtggctttgagtaatagtttatattccaattattgcaagtaatcaatcatataccaggtaatttcctgacatgagttacataccaaaaattatattggatgaaaagctcgaatgaatataggtaacattccactctaatgtagctttctgtatcttagaacattcaactttattaagactttatagtttttaggaatagagttaataaagaacttggaatcttctatcaagaaataaagaggtgggagtggggagatctacctctggagattctcatgtgttcaggatatattcaacgtttatttgttcctaggcagggtacagaataaactgatacccgtaagtccattctagcccaatgtttcaaaaaatgctggcattttagtgaaatgtaatatggataacataaggtaacattgcgaatagtgaagtctgcaactaaaagataaagcatttaaatgtcaaatagcattgtgtaaataaatctaaaatgaaattttcaaccagtttttaaaacttacttccactaacaaacataacatagtgtcatgcagaagatgatgaggaagcaaagaatatgttaaggaaacctgtagaaaaccaaatgccttcttgtattaaatgagtttaccatgtctttcaaggaataatcatgtttatacaaatgtgtgtggtttccaggacccatttttcttttccttccctatacatgcaaacatatacaaatatatcagctcacatacttatttccctgtggtttcagactattaaatgtttataattactctgcttgatgactgtaatttttagttacagatcgaattgtcccaggtgtggatgctgccaaaagccacggtcattggcaacatgacatctggaagacagtctggcatgtagagtcagggaatttgctagaagttgttcctcatacagtgcaatagtacaagcaagcattgtgactccctgcagctggtgctgtcagtgccctatccatatgcctcagacctttaattgtgtttctgaggaatgcttctaactcctagtatctgcaggtttgttcctcagcactttttccaaaaactgtgggaaattgcactgcttatatgcacaagtgagcttcatataaggagaaagaaaaccctctaggaatagttcttaattaatgactctcaagaggtgctgtataaataccaacttctctcacctctctggtgggataactctgtgaggtgtgctttatgtcatgtcagagtttctctgcaggattgcctgctatattcactgcttgaatagaaaattcttttttttttttcctttgagacagagtctcactctgtcccccaggctggagtccagtggcacaatctcgggtcactgcaacctctgcctcccaggttcaagcaattcttgggcctcagtctaccgagtagctgggactacagacatgcactaccatgcccacctattttttgtatttttagtagagacacggattcaccatgttggccagactggtcttgaactcctggcctcaagtaatctgcctgcctctgcctcccaaagtgcattgcagctgtgggccaccgcgcctggccaaatgttctttactggacgccttcaatccccttgtcatttcctcattttctttctggcctgcacttcttaaactagttacactgtaatacttgttttagagtctgcttctgtgattaacgtttctgatcagtaaaatggcatagcactgcttacctcaagagatggccgtattttgtcagagaaagaatgtacttcacgttttgcctaataaagtaaacgttcaggacccagcagttgcattttaaatgatcccagtgtttgccctgtttttgaagtacacatgtgcttctgggaaaactcaaactaagacacaccccacacccaactggcaaacacatgccctgttgaaagagtctgcagaagagtccttgcttcaggtacatttttcacattccagtcccagtttagccctcccccatcaccttaatgaccaccattgcataacaagcaatgccttcttgtgaggcattagaggtgactaggagtgagctttagggtgggtacccttcagggggtttctttttttttttttttccttgactaggagtctggctctgttgcccaggctggagtgcagtggcgtgatctcagctcagtgcaacctctactcacgggttcaagcaattttcctgcctcagcctcccgagtagctgggattataggcacttgccaccatgcccagctaatttttgtatttttagtagagacatggtttcaccatgttggccaggctgatctcaaactcctgacttcaagtgatctgcccaccttggtcttccaaagagctgggattacagatgttagccaccgctcccagccccagccttcatattgtttatcttgatttcttttttcttctctgttgtagtggatagcaccagacaatcagtagttgaagcccttttcacatcttcactgggcattctattaaatgacatatgtgttctccccaaactctaacatctgttcattgaaaatagggcaaacaccaagaccatttgtaatacaattgctgactattgaatatttactttgttagaaaaaatgctaagtactttacaatatttctctgcaataaaactcatcttttgagctaacaatgctattctcattctactaaggagaaactttagtcacagagagattaaataatttgctcaacaacacacaaggaagtaagagtctgggagagaatttgtacttttcccttccttttagatgtcattcataaaaaaaaaaaattagtgtacctgattttgtactcctagccactatttaatcctgcctctgtaattagcttttatggataagtttatctttccgtactcagaaaataaaatagtaaaataaaaaggcagcacaaggtgtcactaagtggctttcaccagaggtgaagttgtacagaattagagaggggttttaaccacatctagagcactgcccatagaggaatgcagaccaatttctgaagtcaatttgtgttatcccctgctccttaacctgggttccaataccagttacatttaaggaactctccttccccctctttccagacatttccatggtagaaacacagtagtagttcaggagttaggagacctgggctttagagctttttataaaatgggatgtctgaatttgatagtgtgcaatgttccttccaactccaaacagatgttgtcattttcacagcctctagaagccacaggtaccttctcaattagaagttctaaatgatttgtaatagtgagcactatttggattcctgacagcctatatcaggaaaataagcaaagttttggatcaagtgcttatatctaaagccattgctttataagctggtcttcactgccaattccttcttccctatagattgttggtatttctggtctggatgggttacaagaatttattttattgatttcctgaatctctgtacatccttaaaataattcagaattggaaagaaatacatttagctctttgtcacatagtgtagagatcttttgacataaagagagagctgctgatattctgtttcccctaatgcctgagtgtggcatggtttcaaagggttgctttatcacatgtagacatggagggaccatcaggtaatgagatataacatttcctggaaattaattagtggtgtgttgtccaggaactaaatttcttttactcctgtttgccacctgtcctggatgtctagtgccgaatttgaatttccatgccaaactgaaaaagcagcattggctttagttgccctctttttcacattaacttagggttttagcatgtaaagcgactgcgttgttttagtggaatgaacttagaatgaacttcaacagtgatgaactgataaccaattaaataaataattgattcatctgagaacagtctgactcctagaagtggtgttcctaagaagcttttgtgtaactgccctctggaaagcctcacaagttgttgcctttctttctttattttttccaaatggacaatttttgacaaacaaacttctaagagcagtcaagtgtcaaatacaaagttatggctggtgcagctgcctttgggatcacacgctccatttattcattatagaaagctcagatgcacaaacatgtggtgccattttgtgtacctgtcagtttagtgcgtttaatgaacattgatcatgctcatccagacacacttctcgatgctgcaagcaggaagtcagtggtttctgaaagacagggtgaaaacttgttttttttttttttttcaaatgtgcctctgtggaatcctttttgcccaaaatagatgcattaataaacatgactaaaatgtaccttaaattcactacaaaagagaaaagatgttgatgaaaaatttgctctggttttgctaatattaagtccagtatttgtctacttaaagtagaagttttgatgacttggataatcattagattgctatctagctatttgtagttttgtagcatcatctgttccaaaactgattttttgctctcttttaataccctgttaattacaaaacctcctactgggtagttttaccatacataaattctgtcaagtactgctgaattaattggtgccgaacatcgttccggtctatggtgggagtaatagttcttattttcttgccttttaatgtttggacacaggaaaaggaatatcacacaccagggcctgctgtggggtggagggagggggttttttttgattaggcaacatacctaatgtaaatgacgagttaatgggtgtagcacaccaacatggctgtcaaaattcctttcaaaattctcataaaagaggtagtttagcttctttttttaaattgtattatactttgagttctagggtacatgtgcacaacgtgcagggttgttacatacgtatacatctgccatgttggtgtgctacacccattaactcgtcatttacattaggtatgtttcctaatgctatccctcccccctccctccaccctacagcaggccctggtgtgtgatgttccttttcctgtgtccaactgttctcactgttcaattcccacctatgagtgagaacatgtgatgtttgtttttttgtccttgtgatagtttgctgacaatgatggtttccagcttcatccatgttcctacaaaggacatgaactcatccttttttatggccgcatagtattccatggtatatatgtgccacattttcttaagccagtctatcattgatggagatttgggttggttccaagtctttgctattgtgaacagtgccgcactaaacatatgtgtgcatgtatctttatagcagcatgatttataatcctttgggtatatacccagtaatgggatgactggatcaaatggtatttctagttctagatccttgaggaatggccacactgtcttccacaatggttgagctagtttacagtcccaccaacagtgtaaaagtgttcctatttctccacatcctctccagtacctgttgtttcctgactctttaatgatcgccattctaactggtgtgagatggcgtctcattgcggttttgatttgcatttctctgatggccagtgatggtgagcattttttcatgtgtctgttggctgcataaatgtctttcttcttttgagaagtgtctgttcatatcctttgcccacttgttgatggggttgtttgacttattcttgtaaatttgttagagttctttgtagattctggatattacccatttgtcagatgggtagattgcaaaaattttctcccattctgtaggttgcctgttcactctgatggtagtttcttttgctgtgcagaagctctttggtttaattagatctcatttgtccattttggcttttgttgccatttcttttggtattttagacatgaagtgcttgcccattcctatgtcctgaatcgtattgcctaggttttcttctagggttcttatggttttagatctaacatttaagtctttaatccatcttgaattaatttttgtataaggtgtaaggaagggatccagtttcagctttcaacatatggctagccagttttcccagcaccatttattaaatagggaatcctttccctatttcttgtttttgtcaggtttgtcaaagatcagatggttgtagatgtgtggtgttatttctgagggctctgttctgttccattggtcttcatctctgttttggtaccagtaccatgctgttttggttactgtagccttgtagtatagtttgaagtcaggtagcgtgatgcctccagctttgttcttttggtttaggattgtcttggcaatgtgggctcttttttggttccatatgaactttaaagtagttttttccaagtctgtgaagaaagtcattggtagcttgatggggatggcattgaatctataaattaccttgggcagtatggccattttcacgatattgactcttcctatccatgagcatggaatgttcttccatttctgtcctcttttatttcattgagcagtgctttgtagttctccttgaagagctccttcacaacccttgtgagttggattcctaggtattttattctctttgaagcaattgtgaatgggagttcactcatgatttggctctctgtttgtctcttattggtgtataagaatgctagtgatttttgcacattgattttgtatcctgagactttgctgaagttgcttatcagcttagggagattttgggctgagacaatgggattttctaaatatacaatcatgtcttctgcaagcaggggcaatttgacttcctcttttcctaattgaatgccctttatttccttctcctgcctgattgccctggccagaacttccaacactatgttgaataggagtggtgagagagggcatccctgtcttgtgccagtttgcaaacgaaatggttccagtttttgcccattcagtatgatgttagctgtgggtttgtcataaatagctcttattattttgagatacgtcccatcaatacctaatttgttgagagtttttagcatgaacggctgttgaattttgttgaagtccttttctgcatctattgagataatcatgtggtttttgtccttgtttctttttatgtgatggattacgtttattgattttcgttatgttgaagcagccttgcatcccagggatgaaacccacttgatcatggtggataagctttttgatgtgctgctggattcggtttgccagtattttaatgagtatttttgcatcgatgtttatcatggatattggtctgaaattctcttttttttgttgtgtctctgccaagctttggtatcaggatgatgctggcctcataaaatgagttagggaggattccttctttttctattgattggaatagtttcagaaggaatggtaccagcccctctttgtacctctggtagaattcagctgtgaatctgtctggtcctggactttttttggttggtaggctcttaattattgcctcaatttcagtggctgttattggtctattcagggattcaacttcttcctggtttagtcttcggagggtgtatgtgtccagaaatttatccatttcttctagattttctagtttatttgaatagaagtgtttgtagtattctctgatggtagttaatatttctgtgggatcattaatgatatcccctttatctttttttattacgtctatttgattcttctctcttttcttctttattagtcttgctagcggtctatcacttctgttgatcttttcaaaaaaccagctcctggattcattgatttttttgaagggttttttgtgtctctatctccttcagttctactctgatcttagttatttcttgccttctgctagcttttgaatgtgttttctcttgcttctctagttcttttaattgtgatgttagggtgtcaattttagatctttcctgctttctcttgtgggcatttagtgctataaatttccctctacacactgctttaaatgggtgccagagattctggtatgttgtgtctttgttctcattggtttcaaagaacatctttatttctgccttcatttcgttatgtacccagtagtcattcaggagcaggttgctcagtttccatgtagttgagcagttttgagtgagtttcttaatcctgagttctagtttgattgcactgtggtctgagagacagtttgttatacttcctgttcttttacatttgctgaggagttctttacttccaactttgtggtcaattttggaataagtgtgatgtggtgctgagaagaatgtatattctgttgatttggggtggagagttctgtagatgtctattaggtccgcttggtgcagagccgagttcaattcctggatatccttgttaattttctgcctcatggatctgtctaatattgacagtggggtgttaaagtctcccattattattgtgtggatgtctaagtctctttgtaggtctttaaggacttgctttatgaatctgggtgctcctgtattgggtgcacatatatttaggatagttagctcttcttgttgaattgatccctttaccatatgtaatggccttctttgtcgcttctgatctttgttggtttaaagtctgttttatcagagactaagattgcaacccctgcctttttttgttttccatttgcttggcagatcttcctccatccctttattttgagcctatgtgtgtctcttcacgtgagatgggtgtcctaaatacagcacactgacaggtcttgactctttatccaatttgccagtctgtgtcttttaattggagcatttagcccatttacatttaaggttaatattgttatgtgtgaatttgatcctgtcattatgatgttagctggttattttgctgagtagttgatgcagtttcttcctagcctcgatggtctttacaatttggcatgtttttgcagtggctggtaccggttgttgctttccatgtttagtgctttcttcaggagctcttgtaaggcaggcctggtggtgagaaaatctctcagcatttgcttgtctgtaaaggattttatttctccttcacttatgaagcttagtttggctggatatgaaattctggattgaaaattctttgctttaagaatgttgaatattggcccccaactctcttctggcttgtagagtttctgccgagagatcagctgttagtctgatgggcttctcttagcgggtaacccaacctttctctctggctgcccttaacattttttccttcatttcaactttggtgaatctgacaattatgagtcttggagttgctcttctcgaggagtatctttgttgcattctctgtatttcctgaatttgaatgttggcttgccttgctagttggggaagttctcccagataatatcctgcagagtggttttccaacttggttccattctccccgtcactttcaggtacaccaatcagacgtggatttggtcttttcacatagtcccatattccttggaggctttgttcgtttctttttactcttttttctctaaacttctcttcttgcttcatttcattcatctgatcttcagttactgataccctgtcttccagttgatcgaatcggctactgaagcttatgcatgcatcaggtagtactcgtgccatggttttcagctccatcaggtcatttaaggacttctctgcgctgttgattctagttagccattcatctaatcttttttcaaggtttttagcttctttgtgatgggttcggacatccttcttttgctcagagaggtttgttattaccgatcgtctgaagccttcttctctcaacttgtcaaagtaattctccatccaggtttgttccattgctggcgaggagctgcattcctttgaaggcaaagaggccctctgatttttagaattttcaggttttctgctctgctttctccccatctttgtggttttatctacctttggtctttgatgatggtgacctacagatgggattttgttgtggatgtcctttctgtttgttagttttccttcaaacagtcaggaccctcagctgcaggtctgttggagtttgctggaggtccactccagaccctgtttgcctgagtgtcagcagcagaggctgcggaacagcaaatactgcagaacagcaaatgttgctgcctgatcgttcctctggaagcttcgtctcagatgggcacccggccatatgaggtgtcagtcggcccctactgggaggtgcctcccagttaggctacttggaggtcagggacccacttgaggcggcagtctgtccgttctcagatctcaaactccgtgctgggagaaccactactctcttcaaagctgtcagacagggacgtttaagtctgcagtagtttctgctgccttttgttcagctgtgccatgccccgaagagttggagtctacagaggcaggcaggcctccttgagctgcagtgggctccacccagtttgagcttccttgctgctttgtttacctactcaagcctcagcaatggtgggtgcccctcccccagccttgctgccaccttgcagttccatctcagactgctgtgctaacaataagtgaggctccgtgggcatgggaccctccaagccacgcgcgggatataattttgctaaaaccattggaaaagtgcagtattaggatgggagtcacccaattttccaggtgccatctgtcacggcttcccttggtgaggaaagggaattcccggaccccttgcgcttcccgggtgaggtgatgcctcgctctgcttcagctcatggtccatgggctgcacctactgtcctgtacccgctgtccgacaatccccagtgagatgaacctggtacctcagttagaaatgcagaaattggccgggctcagtggctcacacctgtaatcccagcactttgggaggccgaggcgggtggatcacgaggtcaggagattgagaccatcctggctaacacggtgaaaccccatcaccctaaaaatacaaaaaattagccgggcgtggtggcgggcgcctgtagtcccagctacttgggaggctgaggcaggagaatggcatgaacctgggaggcggagcttgcagtgagccaagattgggccactgcactccagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattaccaaaaaaaaaaaaaaaaaaaaattctgtgttcaattagtttaccccagctagaggtgcattatatttagcaatgatttacttataactgttgtgtgggagaatatcctaatcagtttttggaaaaggctaagtatacctatattattctacatgtgttgttattttagcatttatatttcttttgattgagattttgtttcatcaccctggggcacaagatagctcaagaagacagatgtgctcaaattatgcaacagacttatctaaacagctcatgggtcttccaagttcctgatgaaaattagaattgaatcataatgctaagtgtctcacatatccaccctttagacttgatcatcttgtgaaataaatggagcattgcatccagtatgtggtacacttcaagaaaaaaaaatattcacctagcctttttgtggtctaagactctatcatttaaaaactttaaacaagtatataatgaagtgtattcagagatattcattgtagctttgtttgtaatatgaaaaaatcatgaataatctaatattctatcagtagaggaaaggttctaaaaggtatgggccgcacctgtactagaatattataaccccattaaaaataagataggccagtatattctgttatgaagagatgtgtgtgtccgtgagaaaagcagcatatagaacaatatgcatattgtgattattttcatttcataaatgcattgaaaaaatgtacttcttttttatatgtacgtgtatgtaggtaaatgcaaagaataagttttgaagcaaaattatcttcctttatggaggagaatgggatagggcacattgaaaaggtgcttttgatacaaacatctccacttttcagttttgcaaaagtgatgcattagactgaattttgtctaattgtgtgtaattgactttttttaaagaagaaattccgtggaatagataagaggaaccataattaatccaatcaactcagagggactgaacacgtgttatgtgtcagtcactatgcttgccgctgaggacacagtagagagcaaagaaacatgctggccctgacctcagggatatagaaactataggaaattgtataagtgtgcaaatttattattatgtaggaaaagtacaggaaattagaaaatcttacagttttctggtcagtgaagttttcctgaggaaggaatttttgcaccaacaactggagcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagccaggtaatattgaagccagaatatttttgtttcttcatttttgatttacttacgtagaagtggcccaagtgagtttcaactcaccatcacccacattatttgagtaactaaacatctgccattgcccaagccatacccaaatatcacctgaactaactctccctttctcccttccatcactgtgcttatgcattcatgtgtccaataaaatatttatggaacgttttgtatatgctagatgttggggaaagcaaacatggtccttactctataaatgtgtattctgttggaagaaacagacaaaaattaatagtcacaaaaagtgattaatgttatgaattaaatgattgaggtgccaagatagagaataaagaagagggcttattttagttgtttttttcagtgaaggtctctgaggaagtagcactgagctgagacttcagcattagaaagagccagatatgacagcatttctccccctttttaaagccaaatagtattccaccctgtgtgtgtgtgtatgtgtgtgtgtgcgtgtgtgtatgtgtgtatatatatgtgtgtgtatgtatgtgtatatatatgtgtgtgtatatatatgtgtgtgtatgtatatatataccacattttctttatccatttatgtgataatggacaccaagattgctttcatattttagctcttgtgaataatgctgctgcagtgaacgtggtagtgcagatatgtctggcacactaactgcttttttttttttttgatacggtctcactctgtcacctaggctggagtgcagtggtgagctcttggttcactgcagcatccacagctcaggcttgagtgatctcacctcagcttcccaagtagctggattacaggtgcacaccaccacacccagctcatttgtttttttgtttgtttgtttgtttgtttagttaagatggggttttgccgtgttgctcaagttggtctggaactcctgggctcaagcaatccacccacctcagccacataaagtgctggattataggcatgagccacagtgcccagcaaaacacactaatttcaattactttggacatatacccagaagtgaaattattagaatcatatagtaattctatttttagttttctaaggaactgccatactgttttctgtattggcttactaatctacattcccatgaatagtgcacaatggtttccctttctccacacctttgccaacacttcctttgtctcttccataattgttctaacagatatcaggtgatagctcattgtggttttaatttgtgtttccctgattatcggtgatgatgagcatgtttgcataaacctattggccatttgtatgtctactttagagaagtgtctatttaggtggctcatttttttattaggttatttgtgggtttttttgctgttgagtttcatatatattttggatattagccctttattagatgtatggcttacaaatattttcccccaatctgtggttgtctctttattagttgtttctttggctgtacagaagctttttagtttgatgcagtcccatttctttatttttggttttgttgcctgcgcttttggggtcatatctaagaaatctttgcccagaccaatgttgcggagcatttcctgtatgttttcttctagtagttttgtagttttcggtgttatattcaagtctttaatccattttgagttgatctaggtttacgatgtgaggtaagtttccaatttcattctacttgcgagtgtcttgccagttgccacaacatggatgaacttggaggacattatgccaattgaaataagccaggcgcagaaggacaaataccatatgatttgacttgcatgtggaattttacaaagttgaactcatagaagtagagagtgatggttaccagaggctgggggagggattggatagggaaaggggaaatgttgatcaaagggtgcaaagtttaatttagacaggaggaataagctttggtgatctattgcacaaagtgatgactataataaataataatgcattacatacttcaaaattgctgagtaaattttaaatgttttgccataaaaaattaaaagtatgtgaagtgatgaatttgttcattagcctgatttaatcatttcatattgtaaacatatttgataacttcacattgtaccccacaaacatgtataattattagttgtcagttacaaataaaatttaaaagaattgaacaaataaaatgtaaaaatatatctgtttaaaaacaaaaaagaaagaaagactctacaagaagagtaaagggaagggcatgtgcaaaagtcttgagctaggaaagaatttgggacattcagccactgaaacaaggagaatgtaaatggagaagcatagcttcagttgaacaaagattgtagtcccagattggtgcagcatctgaggggaaaacaatgaaggcacagcccttattgagacagtgaaagattagagtttgttttgtaatttccggggctggcactgtttttcttggaatcattgaatcttaggtgtggaagactctaaaaggtgatgtaattaggtcattttctctgttgcaggcactttatattggaggtgtgagtagctaaagttctctatgactacaatttttttccacaccttggagccgtttttgtgacagactcaaagacctatcatccatttcttccacgaaggcaatattgaatatatttggagcatcactcctgcctcttcctatatgctgttaattcatgtcgccagcgtcctaaatgaaagtcttcttcatatccaaagaatcttggcaataggaagcatttaaagtcgtcattattttaagtgaagctctcttaaactctgagacagaggagaataattctcttataccacaagaagggctttttcaaatggtcccccatgaaatctatttctgtgtctttccaaaatatgtgaagcagagagttgagccaattatctaaatcatttaagtcaaagagcttaatactaaagtgaatatcctgaattattcccatgattgtgtgtattattaaacaccattaattctaccaattaattaccaattcataaacttctaaaaaacttaaatataaatacagtcatccctcagtgtctgcgaggaattgcttccaggacctcccttatataccaacatccatggatgctcaagtcccttatataaaatggcatagtatttggacataaccaatgcacattctcctgtataccttaaatcacctctggattacttataatacctaatacagtgtaattctatgtaaatagttgttgtaccatttagggaataatgatgagggggaaatgtctgtacatgttcagtacagacacaaccatccaactttttccaaatatttttgatctgcagttggttattagggagaggccaactgtataagctgtatacaatctgtaatagtgaccctggcagcctgtttcagcaaggcttctcagttgacctgcagaacacaggaaattattttagttactcatcttcttagttctcccaaaaaatgctaatgctgttctgttagtattttaggtgcataagagaagcagataatctattacatacaagggatgttcctctatttagaaagcccacttaagaaaggctggtaggttatttaaaaataaaacctagacataaatacatgcctacatgcaatctgtacaaattctacagaaatcattttatatctatttactcttattttcttcccacagaacgtggagcactactatgatttctattcccttgtaattaatttctggttgtcgacttaaactgtgcctttattggcaaagtaaagtgttaaggcaattgaagagacaatgcaggtcaaaaaactgtttatatctctattagaggcaaaagctagacccttagtaaatgtctgttgagtgaagttgaattgaattagtttgagttgaattgaattgaattgctttgagagagcagtagctggagccaattatgactttatcctttggccagtattttcagctgaatgtttcaacaattattcattcaaccaacatttttattgagtgcatacctattatgagccaggcaaaaatgtggttcagggttgtagattcaaagattaaataaacaaggtccctagcttattattactcaagatgtacaaaggaagataatgccatccatgtgtaaaagtaaagagttgtaggcatctctcacaagcataagtaaatgagacaggaaaggcagtgagtgctataggagaaggcattctgaaggactcagcaactgattagagtctcaaggtatgaccttcctaatcagatgaggaaggacgtataattgccatttagtaggcaagagataatgttagtattttctcttaggtgttttttaagcttttaattattttattgaatctttctggaatcactctcttttggcctttggtgttgtggatgtggaaatagggtgttagaaaggaatcctttgtgattttaatgtttggttgggatgttaactgcaaattatgccatcaactctgacagctattttatatatattcattctcactacagtttttaatctctgatctgcagtttaatgtctcttatatcttttattttaagcaacttcatatatttccttcaaatatatatgaaatatatgtatatattttcttcaaatatatatgaaatatatgtatatattttcttcaaatatatatgaaatatatgtatatattttataaatagatatggaggtaaattggtagattgaaaataaaatatatgtattaagttgagaatataccttagaactatactttccttcttttgggaattggctagttgatttttctgatcggtttttttctttagagtatagaatggtggacttggagtttataggtccttagataaaatgtttactttgtgtatagattgcttgagacagattgtgttaagtgtttcttcatcttgaactttttttctgctttctacccatttttatgccagtggatcctgttcattgccaaagtgctcagacacatttaagaactgtatattcctcagtctcaattctagcgagtaaagggaagactctaataattaagtctgtttagttgacactttcataggtttttccctctcttggaatgctttagaagaaaagtttttataaagaaacctactccattagtgtcccttaaaatactgtataataaaataatatctattaagagactcagttatcttaattttcttcttgccatgtgatgaatgacagatttttactgccgtaaatgtgcattttatgtaaagccctttatattgtgaaatttaaaacatataatttcaaataatcaaaccccatatttctaaattcctatattttattccagaaaactagctacttaaaagcaattgaaaaaagaaaaaccctagcataagttctaaaaattttaacatgcaaaagtatcctttctatattgattaaaagatagatatacaaactcactctcaaccattctgatggaaaaaccctggcctgggctctgaagccattttttaaatggaaatcatgaatgattatgattcaggtggcttctagtacacactttgaaaaactctgaagcgtgaagcgtaatcgccaatatctttgaagattcatgacatttatattggcaaggaggaaaggggcacatggtgagctgagggagagttcgtgtagatgtctgggggtaatggcttgcctactttaccagttaaggcatacatcttgaaaataaatcagcattcaatggggtctttgcagtctttgatgtctcagtattaatagatccattcccagcatcaaaattggtactgcattatattttaagcctatgaggggatgccctgcctccagccagagtggttttgcctaccttaccttctaattttttaattccacttcttttcacttatgtttctattgacctccgcaaggtcatagactttctactctttcttaacagtttgttccctttcgccctttatttctttcaccagttctttaaaagcgttcagcattgtagaattttcaggatattcctttattttaaaactgtgttatttggctgggcacggttgctcacgctagtaatcccagccctttgggaggccgaggcaggcggatcacctgaggtgtcaggagatgaagaccaggctggccaacgtggtgaaaccccatctctactgaaaatacaaaaattagccaggcatggcggtgcgtgcctgtaatcccagctacttgggtggctgaggcagaagaattgcttgaacccgggaagtggaggttgcagtgagccaggatcaagccactttactccagcccaggtgaaagagtgagactctgtctcaaaacaacccccccaaaaaaaacctgttttgtttattcatttacttatttgtttgtttactttgtagcaggcccaaacaatgtcttttactcacacttcctattcagaattgtttgccaagataagaaataacaggcagaaagtcatgactcagtacagttaatgatattccaaaagatgctcagctcacatatggtggtggatctcccactggcttggcaggtgcggtaatagcaggctaaagaatgtggaccacggtctggagtctggttctcaagtgggcaatgagttttaaacaggatatgaagccatttctgattgactgatctgattaacatctgcagcagtgtttctccaggtatgattcacagagacgataaagatatactgtatcttcaattctactttttagagagaaaggggccactagctggatgaacactgggacagcaagtgcaaactaggatagtccaggctagactgtggccatggtcaccctgcttctcaactaccatacctagaatcatgggaaatgtttgttaaaattggagatccttaaggattactttaagatgtctgaaattcaaatgggaatctgcagtgcttcctgtttctgggaaattaaaacaaagataacttttatattagagcattaggacattagatgtttcaaagtgtgggctcctgaccaacaaatccacaccacctgataacttgtaagaaatgcagatccctaggcctcaccccagacctactgaactagaagctgggatggggccaggatatctgttttaagactttccaatttattattttgatgcatactgaagtttgagaaccattgttctgttggatctggcaaaccagtgtctttttactttattttatttttttttacttggtatcataataatatgatttttaaaaatctggatgttcttcccactagcatttcctcatgtcagtgatgatcgaattttaaccatcattgaaagaactatagagagatagctataaggagatatgaagatatgaatgttccaccttagcttgaattgtggtcatctgaagtatctgtgttcctctctctttctgtctctgtatgtgtgtgtgtgcgcgcgtgcttgtgtgtgtgtctgtatctgattctaaaatggaggaagaagacaagtctagtggcttggatagctaagggaaaggagtgaaaggaattatggagaagagaagagcaataaaacagagacaaacattgaagcagttgtcttcttagagggcctggttgtgatcctccatttccagtgcccgaggcattcagctctgcagtgaacaccaagatggtcaagttcaccagatctttagctcaacactctgaccattttaaaagcagtgccttttgaaaaaaaatctttgggagtaaattttttagttttagccttaggagtgtcaaaactagtgctagcaaaagcctctggcaataagtaaatgagattaacaaagccaagggaactgcacagaagtgttacaaacctgaagagcagttttctttttcttccataaatattatatttgtaaagatatgcttggcattcagtcatttgtccactgtccagatcactttttttaaaaaattattattatactttaagttttagggtacatgtgcacaacgtgcaggttagttacatatgtataccatgaaactggaaatcatcattctcagtaaactatcgcaaggacaaaaaaaccagatcactttttagtttcataccggcaaaggtacgagctgatggattaagtcacactgacctcagatccattaactgacacaacttgaaaatccctcatatgtctttaaattccaaatgtatgaatgaaattttgtgttgtcatttgtcattgtgtgtctttgtttagatatgaccttaatacatattgtgagcagataatttgtgaattgctcataattctcaagagttccagttcctctcttcacttttaatatgtgcgtgttgtgctaaagcttccaactgatgtcgtgtgagtgtatttgagaatagagacatgtgtttgtctttgaatgatggggtatctatacgttgcaaagctaaacattctgaattttttaatttactcatccattcaacagatgtatatattcacacatatacgtatatatatgtatatacacacgtatgtatatacacacatatttgtgtatgaatgaatatatgtgtgaatatatatacacacatatttgtacatatatattcatacatatataacaaatatattcatacatatataactatatatattttatatatacatatatacatatatctaacatatatgtatatatgtatatatatatacatgtatataacaaaaatatatacatatataaaaagattatatatgtgtttatattttcacacacatatatatttctatatacatatgtgtgtatatgtatatgtgtgtatatatatataaaggttaaatgagtattccatggccctgtatttgattaatggttaattcaggattggaattgatgcattatggtgaggtatatctactgtacattttgggcaccattcacttatatggtcatcagttcatttataaagtgtcactaaagacaaaatgagttgctgcattttaccttcagtaattacaaaataaaagaagtgaaaacatttggaaaaatccgagggagctcctaagaactccattattgggatgagtggactatgatatgcagtaataagcacatgtattaatatgtgattcaaaagtaacattttctatgaaggacaggtatcttatttaagcctcctgcctgtatgatctgattgaatcagcattgcttaccataggacccaagagaaataaaactatatttcccaatattatctgtccccgaaagagactcttgttcatggagaaatattctaacaaagctgaagataaagtataacctttgggggcctcttcttcaacatattctattctgcagagtagcaggtaataaataaggtattagggtagcttttcagttcaaatttaattttgattcctgcagtggattcgactgtggcattcaaacatagatttgcaggtgcagagagagagtgttacttagccctgcagtgtgactaattgctggtaattgtctataggaagggcgttagaaaggcctgtctccagattttcatcatattttacccaaggacactggcaacgtgaggaggcagtctggagcactgtagccattaagctgttggcagtgtgcagtatacaaaatgttggatctaagtttaaagacaagcctgtgtaaaatgaatttttatataaatagaaaactgtgaaaatgtaatcattgaaaaaatgctgtattttcatttctgattaaccttcatttgaaattggctcttagcaacatatacttccttctcatgtcttgcttttttcctctttccagtaactaatattctataactagtatttaatatgctggttagaaaaccaccaggggatttaactggatatgaaacaaaattgatttataatgaaaatatgtgttgaagtaagctttataaaatgggaatttagtatatccttaagtcagatatttctgtaaccttgtgaaaaagcacagttcctatgtcattttggtcacattgtttttctttcctttccctcctgtttctattatgcttttgttaaatcgaggaaggaattcaagtaattagcattttacaattgtctggaactgccaaaaaaatacctaacaaaaaatacacattattatgggaactgtaaagatttaagcagatataactcaagagataaaatgagttattccaaagtgtgaaatgaagaaagtccagatcttggcaaatgagaaaattatcttgctatctgcaaagcattctactaaattttaagatttttttttaatagaatcagaactgcaaggcttgtttgtctttatttattttatcctatgttccttaaatattgaactattgtaatcttgtcgttaacccccatccctaacacacacacattttttttttaattgggagttttgtggatttgtctaaaaaaggaaacactgtgatttaggattttggtaatattcagcataatgattagttttattctattatgtggaccttaagctacttgggtagtttaaatagtgatagatccactagtactatttctttgacagataagatccagaggcttacttctaaatgtgaatcctaaattaccaaacatttttgaaatggttaatgagagtgcatctgtttctttattccaagtttaattttcaactggatatctgcactttgtctctgaagaagtatttcctagaggaggaaaaagccttttgatcctttttaataatttacttatgagaagtaatttacataaaatagtagcttatttatgaaaaatagggagggtgtaaggagggagaggagaagaaaaggtaactattggttactgggcttaatatctgggttatgaagtaatgtatacaacaaacgcccatgacgtgtgtttacctgtgtaacaaaccttcacatgtacctcgaaacctcaaataaaagttaaaaaaaaaaaaaaagaagaaaagtaacttagaattcagagggataagttttaaaggaagccctgtggaagccttgcaggaaaaagttttctttgacaaacctgtcctttcaacataattgatgagttggttccagcctggttccttgtgacccatccagcactgagtaggaaatgacacagaaaatgaatgttgtggtctcatttgtcagccagggccactagtttcttgcaggatacctgaattttcttctgtgcttttctcacatgtgcccatccctccttttctttcagtgcctttctctccctttaaccaccagggcgactgcccttttattagtttcttagcgttagttctaaagagtctgatggcctcttgtaacgtacatattgagcttccatagcaaagaatacaaatcatcacaaatcacaatagtccaataagaaagaatattgatctttccaaagtaatttcagtcatatatgactgagctcaattttaaatatgtatttcagtgtcgacttacccaacacactgaacctgcttctctgatctggtattagacttgtactctgcctacagaccagtgcctaggttagttcatccataaagggaccaaaagcagtgaccactcctcctggggtgaagttcagtgtttctttttttcccatttacttagttaagcagtcagttttaactttactatccagctgattttgtgtataaatggattcatttgtagtttatcttgtttttgctaggctgtgggctaggaaggaccaaatggatttacgtagtttatcggataaaccaattttgagtatcattttgtcaggaaaccctttttaacctcttcctggatagccccagccaccttaatttacactcctctgggagcatttatctttccttcatggcaatgtaattttgtatatatttacatgttctttttaaggcttttcattcagtcttttttgaacaactactttataccaagtcccgttacttcaatgaatataaatggataaaaatctctgccttatgaagcttgtattctagtaaaaaaaaaaaaaaaaagcagaagttaataacatgtaatagaacatcaggtaatgaaaagtgctatgaagataaaacgaggcagagtagaaatagagaatcacctaggagaagaggcagtggcgacattaggtatgctgttccggagagtcctctctgaggaagggatgcagagccaggaactaaatacaaggagatgcttgtcctgggaagatgggcgagaactcttcaggcagaaggggcagccttcttggaagctcatttaccgtattcgagaaagagaaaggcaaccagtgacgctaagagtggtgaatgagggaaagtggcagaaatggcgagtgtagaggctgacagggatcagatcacatagagccttgttgggtgacataagaaattcatatttttttctaatttaagtggaagatcaaagtaggattttaaattgtagctcacctgttagaccatgcctgccatatgaggacagagtctgccattaccactgcagcctagtactgaataaatattggctggctggctggctggctggctggctggtcagacagatgaactaatgtccttccaaccctgttgcttttacttatgtggttttattaaaaacaaagcattttgttggtttgctttgttgctatcagagttacacatattgttattggtattgcatttgtaccccttgacaaaaggaagtttactatttattatcactagataattagaatttcctacctcacatgcctgaaatgccgcatccccccaccccacttcttactatgtaaaaaaaaaaaaaatctatctctctatctatctatctatctatctgattggctcgacagcttgaacgtgattgagtgtccatttaagcctacttgtattttcatctgattactaatcctgaaggataatgttaagccagattctgcagcacagaggtcagaggatcagacatcagctctcctaaaatgatgggatgggatagaaagaatgatgataacccgattaatctccctttagggggactctggagtcaggagatgtgtttgtggccttggtaacagccttcctgctggttagaggaggacctgcatattcttgggattcctctctcataatgggtcacaccacatccaggtattaccacctgggagaagaaaggtgacagctatttttaattctttgataaatctcgaagatagaggtggaaccaaggatgtcatggaacatcatgcaagtgttaactaagtagtcctctttgaaaatatttagatctatagactatcttgccgcttgaaaaacattttatattgctaagtaggaactgtcttcttaattttcttataattctctttgcttgaattatccctaaaaattaaccatagattttcaaataagctcaaagaaaacatggatgttaatgctagattcatcatgtaataattattattatattaatagtaattcacctttgcattttttcatgtcttagtatttaacttctgtttcatgatcctgttcatcctaaagttagcacctttttcttgccatgtatttgccaggcgacatatttgatcggagcttccagaacccatctctctccaccacatcctcttttactgacactccgggatgctgctaatatcaatttgaggttttgcagagatgggggaagcctacattgtctgcatgttctgcccttgtctaggttgtatgattcttgagggtagtgactacatcctattcttttttctgtttcctgtagcacctagcagaaactctactgtatagaaggtattcagctagctgttcaatgactagatggacagatgaatgagtgaatattttatttcctgttctgattttggtaggattcttaagtccataattccctaatctgcccactttgctcagagatacaaatttcaaaattccccttaaccttggagagaccctagggaagggcagcattagcttaagcagtgggagacattttttcagtgtaggatcttttttcctgtgtgttttaacctcttagagagaacgtgggttctttattcctgctgtggcacggtcctgtttttattagcgtacccaactagactgcagcacatatgttacaatgagccatgccacatgcaaagataaacaaatgtgatgttaatgagatttgagtgtagaatctgtttttctcttctatagcctccagagttttagagaattttgtcactgtcccatttaactggcatctttcttaaagggctggctttattcataccaattattttctcattctctccctgattcctttcactcaaattcagtaaactctcatcttccagtacattatcctgcagctcatttataccttcaccctcactccttgaaatgaattcagaatctgatttggagcttgtctctctaagtgtaaaacacctcctgctataaataaacacactcggtttacttaggtttgatacttagatgagttgcatcagcatatgttctacttcacgttatcagcgtcttctgagttgaattctcatcatttttttgccttaaaaatgacagtgctaaatatgtcctgagggactaaggcaggttgagaaaacctctctgcagtattggagaaagccaagttaaatccagcctgctagcctaatgtaaacaatataatcgttcttcccttatttactttatttgtgaggatcatatactagtaaactggggtagagtagatgagcaaaaaataactaggggaagaacaacatgaacggcaaagttgcttatgcaacaaaagacatgtcatattttatctttcaatttaagaaaaaattatgggagtttcatatgcttgacactatcattattcctctactaactgccttctattataatgagtcttctttttttctcccagtcaacacattacatatacctctatttaacatttatttcttgattagttgttcataggtgtatcttttcccagtaccccacctccctccatacaaggagcctaagcatattgccatgaatgtaacagattccaagtacatgcctgttgtgttgaaacattgctcaccaatcacaaattttggcacattctaattatctaatgtctttaagagttagtgttgtaataaagacttaataattatttgtctatcaatcattaagttgatatcagtgtaccaggaatagtaactcctcaaaaaaagccagtgtttatgattaacttctaacatttaaatatgctatgtctatatttataatatattttatgtgcttgtttattctctgtatccactattataatgttcataagagcaatttctttttctacgtagcaagacctgtaagaatataggagagatactgtatttatatatgtatgtatatattcaataaatttattcaaaaatatgtgttgagtacagatatatgtacatattctgaatgaatatattaaaaatgtatataccttatatgttcatatactcagtatgaatattcaatacattatacatatctatactcaatacatatttttgagtgaattaattgagtacttcttatgtgttgggttctgttaataagtacttcaaatgcattatctctttcaatccctcaagattccagttaagtgtagatactattattatcctaattttaaggatgaggaaatgtaggtttggcattggtaagtggttttctgaaagatattcaattcataaaaaagatagaatcaagccttaggtccaggcctgtctaacacaaaagcaaatgcccttagctactgtgatatacttctcctacagtaattaactgagagaaaattttgtgtgaaaatatggaaataattgtgcctggtgggatcatggacactaacaggataagatcatcaaatagtcctgtggtcccctatgatgaggtgagcgtagccaagcccagagcaggcagcgaagcctggtgggggaaaagctgtggggcacgcaagagaaagaggtcacaagcctggggcagagaatgtagtgtccagttggaagcatcatgaatcagaatctgggtgatctgtgattctggaactagagtgttgccttaaaagcaagtatattcacctctcaagaagaaaaaagcaaatgagaataaagatggaatggaagatctatcaagtcattgggacactattctcgactgttggagtgatagggagttgtgtgcagtgattgggcttctcaaatgcaagtggtgaaaactcaactcaaatgaacttgagaattgtcctctttctccccaggatctaaattgaacactcgaaagctatcggaaggttggtcgagggcatgaagtagtactctgccaaggcttttttattaacagctcccttttctgcatattcccatggagccagaggaagtgattctctgaatggatatattctgctagtaacatatcgtggcagctgtatccgttatccatttaacaattattactgagtacaggacaatatagagaatatgttacttcctctgttaactctgccctggttgtccagcagcccaggtgtcctcacctgttaactgagagtgagcaagtctaatttgtgtttggtaggcagattaagtaaaaatgtataggaaagcatcgtgtgaatgatgaggtaccatatcaatatgaggtactattttatcatcagtaccaagccatgtaaggctacctttctatctccagaggcttttactttaaatctccaacctagcccatgtaacttttttttattattacactaatttccacttccataaaaaaggtcacagttttcagagagtgcatattacttatataactgtttaatcaaaggatcatgctaagatataaggaaaacctagaatctttatacattttcccaagctagggtgatgtttggagcatgttggatttaaaagacagaaaaataatagagaaaagctttgctattttcgagatcattatttgaaagatagtttcatcaaccactgataggtaagtcatctattaatgggcatttgggttgttttcagctattgactattgtgaataatactgcaataaacttaagaatgcagacagatagggctgggcgtggtgactcacacctgtaatcccagcactttgggaggctgaggtgggtgcgtcacctgaagtcaggagttcgataccagcctggccaacatggcaaaaccccgtctctactaaaaatacaaaaattagccgggcgtggtgatgcacccctgttatcccagctactagggaggttgaggcaagtgaactgcttgaacccaggaggcggaggttgcagtgatctgagatcatgccactgcactccagcctgggtgacagagcaagactccatctcaaaaaaaaaaaaaaaaaaaatgcagactgctagctctttgagatcctgatttcaattcttttggacatatatccagaagtggtattgctggatcaaatggtagcttttaaaaatgtggtatatttatgcaatggaatatcgttctgtcttaaaaaataatgaaatcttgctatttatgacaacatggatgaacttggaggacattatgctaagtaaaataagccagacacaggagtccaaatactatatgatttcacttatttgtgttatctaaaatagttacactcacagaagcagggaatgggatgcagttgctagagaatggagggaggaggaaatgggaattgttgttcaatgggtatagactgtcagtcaggcaagatgaaaaaattccacagatctgttgtacaacatagtgcttatagttaacagtactgtattgtcactttattttttgttaagagggtagaagctgggtgtggtggcttacacctataatcccagcactttggaaggccaagatgggtggatcacttgagcccaggaatttgagaccctcctggcaatatgacaaaaatccaatctctacaaaaaatacagaaattagctggtcatgctggcacatacctgtagtcccagctacttgggaggctgaggcaggaggatcacttgagcctgggaggtcaaggctgcagtgagctgagatcacaccactgcactccagcctgggtgaaggagtgagactctgtctcaaaataaataaataaataaataaataaataaaataaaaaagatgccagtcaggtgtgtgtataggagctaggagatagaagagatgtgtttgtatgttttcttgtttaaagatttttgaaggctatgatgattctcaatattgcactttgcaatggtagtttggtgacaggtttagcatagctatttggcagtgggattccttggaggtgtaaaggttttatcagtgtcactttgtctcctgtccaggtttttaccggttaaaaaaaaagaactaaggagccaaatgccactcaaggttttattaatagagactgaataactcccaatacaggctccttgctaaaatgcaactagtgaatttggcttggaccaaagcccccactttgaattaagataacttgtccccaagaagagtcaacctgactcaaccaaacaagttacaggcaaataaattggaataaagaaagaaaatacctggctgggcctgaaaaggcagaccctgtcctctctgcttaccataggcaggcaagaaccaagctgagctcaccactcacattgttaaaggaaaagatcacagcagatattacagagaccttcctttccctagggaacaagtgaggaagggtgaaggggggccaagagtggtattaactttgccccctgaggtgggaagactactcaattacttttctatgacctaaaagaagaatgtagagatagaagggaaggtatttggttttctccttcatgattaatcaattttatttatgagaatagagaagaaatattcctaagtaaggaagtaagagtgaccttgaaactaggtatattattatccagatatggttatagtctgaatttaatttttattaatgtaataatagcttacatgggccttatggcgacattactagcactctaaaatttaattagatttttagagcttctattaatgtcttttgtaggattatacaatctggggcatcaccagcaagcttcatacattttattttcattatgatttgaaatgagaggaatatggtattttgtgaattaaaatagtttagactggggaggtcttaaaaaaaaaaaaagaaaagacaaccccagagggttgaaatcagttttttttgtactaaactggttatatgtatttttatatagatcttaaatatatttattcaccaatattaaggaattaccagttttttatttttatcaaatttttaataaatattagttgactgtaaccatataaatgtagttatcctcacgatagtttaaaaataatcattttcatgcaacatattttctttagtgtgtatatttcttgagttttttgcgctgatgaagtaagtattccattttcatggtcccttcattattgtatcctgattatatatgtaatatgccttcccaggttcagtaaatcctttaaattaatagaaaaatctgttcagccttgttgagagtcactgcatcaatgtactggttacttttgtaaattttaacccatttatctctttccctcacattccaaaaacaagaactcagggcacacattaaatctctattttacataaagcgtgctcttgaaaaggagatagatactatagattcttagtgacattctttgagttttcaccattcaaactcttaatttagagtagcctgcaaatcaggtacatgcctaggtgacattcacagagaatggaaaagaataaccctatccagaattgacataaagtgttagcattgtatacagagcaggaaaaatgggaacaggaatcagaagctcatttatagactctgctatctactgctatttgatccagaaaagtcattttacttgccctggcctgagttttcttctctgcaaaattaggccgttgggaaggaaggtctctgcatcccatctgagccccagcaatatataaagttgattactgcaggagcaccaagtgttagttgctttgtgcatgcatcatgcgaattcaccgaggctttgtgcagccatgctctgctgcagtagttctgtccttacatgccttctggtggctttagagagagattctatttgggaagggacttagtctggcatgattagagcctagtaattacaaaagtgccaagtgatcctcatctataattacagtgctagtttgttactcattgtccccgaggccataacattaggtggaggagggcatgcgcacggttcctgaaacttaaatgcatccatacttttagtgctgtattttttgctgaattggtatttatctttaatgaatgccaggcttctaccctttcggaatcaatcacttctgtttatgagttggaaaaagacagggaccagagcatgtaggagtatatgagagacagtgtcttattactcagcttatttcctaatcctcgtatgaagataagatcataaaaaatacaaaacaatgtcagggaaagggaatatcaaagcccagcttgttaaagagtcatgaccccagagaagcctagacccctcttctccatgaactctaaaaaatcacctttttttgtgtttttgttgtaatactggccttcattattgcaaatcttcctggttgtactttacaatgattttaattttgtttcctgattagatctttgcaattattcgtaatgttcatctgagtgaaataaaatgatatacactgaagcagtgttaacagattgtaagatttgatatgttttgaaaagaaatggtaatgataaatgacagtgacctaatttgtggaacaatcttcttgtacaaaataatctagtggttggtaattatgtgattaactcaccaagaaaaaaaaaagtcaatcaagtcagaatcatcaagttatagaatcaaaaaaaatgtctggaatgttcccagttaattcattacctacagtgaacttttcatgtgaatgccaaaacataaatactattttaaaaacatttaggggaaagatgtacatttattaaccctaaaactcaaaagacaatcaagaaggaaaaacagcgaaaatctcgaaaagcagtaatgatagctgcttgttgttagtacttatgaggcactttcaccaacataaaacctcatctcaaaataaatgagtgaaggagtaaggcacaatataaccaagtccattttcaacatgaggaacttgaggctcagtgggattcaatgccgtgttcatgatcatgtagcttttcagaggcacggcttcaaaatttgttacctacttcatgctcttttaactatgtgctgttaagaaaataaaagtgaaatatctatgggatatcaattctgaaaaaatattagcacatttgattaggaactgcatcattgagaattcagttaagactttatttataatgcacaaaagcaatagatatgtataacttgaaggtcagtgttataaacatagcccaaactacaagtcaacagagtgaattatagtttggttaatatgcaaaatcattaagatggtttgacttgaaaccagcaaatcatatgaaactgtatttataaaactacaattacaatttagaagttattttgaaaagaaaatcacactttcatgatgggaatatgaaaaatattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaagtgatttctgtgcttgttgcatggatatcctcagaattctatagcattctgacagggtagatataatcagccccatattataagcaaagaacctgaggctcgaagaagctaacttgcctgttgttacatggcaagagtatggccagaattcaagtctaggttgtttaagttccaaagtctacgtgcttgtttcctactccattagtgatcttacctctcctctaggatacctttcatattaatttgatactcagtaagtatttcatgattgaacggctgaatacctgaatgtgtgaatatttttaaaaactttttcgatcacatttatcctggagtgagatgaaaatatagctgttgcatttaagaatgtaagtagtgggtgagtaatttagagatatcataataagcgttttggaagtagagctaaaagataaaagagtctttgattataaataactaaaaggagcagccaaatcactaaataccaggcatacttcatctgttagtggccttagggacaaaaataaaaccagtaaatatggtgtggaagcaactaatcatcgctggattgctcaagagaggatatgtgtgagacccacataaaggtagggatggacttatgagttcttccagtaaagggctgccattgaacacagcaagggctgtggcagacagatatgcaggaagcaataggcaaatttaatatcagtaaggaagaatcatcaagctgtgtttggcttaataataaccattattcttcatttggggttattgattgttctgaaggctacgacaagtgtaatgaactgttaccaccactttgggtgaatgttggccctcaaatgatcattatccagagaggacaatataaataaagtgctgaaagtacagcaaaaagaagagagttagaaaagggagaaagtgggtcttgcttccttccctagtcttttttcttttttttaaggggagacacctttgcttctatactttacttcccattaccggaaatctcttcagcgatccgttttaactgccctggtagtggatcagaagaaggaggacatttttactgttaaggttttactgttttgtcagtgatggaggaagggcgcctccaaaaaatatgcaaagttaaattcagtgtttcaataaattgtttgtttagccagacgtgtctgagtttcttgcctcttcgggtagtcattcctgaagtgtgtcttattgagcagagataacattattgtgtagtccctgaaagagaattggaaccaagttttgggggaaagcttttgtgcacaggtcagcaaagttaactgttgtattagtggagactaaacctggacactagatattcaaaacttgcctctcttctctctgtcagttctctcaaaatcagggttaatattcaaatatattaaattcaaattgaatttgttcctagtaagcacttactatgtgggaatattttgctaggcacagtagattatttaatccatactgtagacaggtcacataggcatttataatctctgttgtactatcatgaattgaggtgaagagagattgggtcacctgctatctgcacagctaagagcaggtagagctgggaactgagttcaagccttcctgaatctgaatctcatgatcttttaccatacaaacttgcctgaatgtgaattgactggccttatgagggagtaatttccccatcactgtgataagagtagcagtcttcctcctcctctcccttcttttcctactcctaataaagcaacacctgcctctattattatgaatgttatctcaaattgtatatatttatttctattgagttgaaattcacataacatagaactagccattttaaaataaacaattcagtggcatttagtacgcttacaccgatgtgcagccatcatctctattagtcctaaaatattttcatcaccttcaaataaaaccccattcccgttaaggagttactcagcattcctcttcctcactccacttccaaccctagcaaacaccaatctgctttccgtctctttggatttacctattctggatatttcgtataaatagaaccatacaatatgtaaccttctgtgtctagcttttttcatttagcatgatatgtctgagactcatccacatcgtagcacctgtcagtatttccttcttttttatgtacaaataatattccactgtgtatatataccgcattttgtttatccattcgtctatctatggacgcttgagttgtttccaccttttggctattgtgaaaagtgctgctgtgaacattcatacacaagtatttgcttgaggaactgttttccattctttgggagctacatctgtttttggcatttactttgtgctagtcaatgaactgagtgctttgtaccaggaactctttagattctcagaaccctatgaggtgaatactattattatctctgttttacgaatgaggaaatggattcacagagaggttaaagtacctcatattgggtcacgctgagattaaacccaatgagccaggttcctgagtctgtactctatactctttctttcttttgttgcgtcagcttcagacttgacacctagagctgcttctgctgttccctccccaataccaagcttgcctgcttttcccgggcatactttcaattgttgtgtttcctcttaaaattcagaatccaatgttgcatacaatattccaaaagtaatttttataattattaccatcattgccattgttgatattttgataacatttgaaaggcactttgatgtttttcaaaacaatatgtattagttttcttccttaataatgaaaattatataacaaacaacaaaaaacaagccccaagcttcatagcacagagtatgcctgttggcattaaaaaataaagtcacggtatatatacagggttaaaaatccaaacagtaaagaaatatgtaaaatgtttattaggatttttttctggaaaagtaaattatgaatattcccaaatgcttgttccagatgtgttctgacaatggttgggcgcagattcccatttatgtcctcaatcagctcattttaagctcattcagcaggtgtataacaaaccaggggagactaaaactcccaggtccttttctcgtgatctgctactgagtcatagcccctgtctgccatattgggcttatgcagttgattttctcaacctaaatgcagaaatttccatgtccctgtgtaattcattaagcatgttttagcccaatgcccttctcaaggtacgtttacatcccaagtgtgagatcctgtctgttaactgtctttctcagttgagaaagcacagataactctgccacttggccatgctgagggctcatgaattacattattagtagaaatgagattttgaccacctcaggattcacttagaagcgtgttggaaagattcctgctcagaccaaacatctcccaccttccattttcagagtaatgtgttccgtctgtggaaccacagcttcatttgcatggaagtgatagggagccattctctacagcattgcaaactatggagactgtatacaagtctcagttgcagtactgaattgcacactctcctgctcagtataatttattagctggagatgtgcctacattaatagtatttgaccacattttaatttaactgtgctacaatgaattaaaccaaatagtaaagttacaatgtatgagtccatttttataccattagaagttaatattaacctataaagtgaattgtgtttaaaaaatgaacgatgttttatctaaccctgacatacatatctttcttgtgtataacagtcctatagggtaagttgagctaagcttttacttgtatctttttaaataaactatctttgttagaatggaaatctctaatgatcagatatgtataattgagttttcatatcttcattaagtttaaagatattaattaagcattatctatctatttattccctcttatgagatgttgatagagatcatttgggagcggacaatacttgttaaaactatgtgcagttttctaatgagcctttcaagaatgtgcgatttttttttccccacgaagttagtacccatgaattttgtgatttcttttcttaaggataaagacaagccaaatggttgtcttgcttttttaaggttgttttatataactagagattcttcttggcttcctttttaaatggattttttgataggaagaaaatgcaaatgaagtaacagtggagctcataaatttctagcctggtgactataatgcagggtattggctttgctatcaaacttccccaagcacatttgctttgtattagtgacttatgcaatattggatctttcgtctgtacattagactgtacaattcttcctttccgcctagcatgctttgcattccactctttagacagatgtgtgtgaatgtagcattctttctcagctgaagctaacaagtgtcagcatcagatttcccctatatattccaaatctgataaaaggataccctgtggttatgaaaattatagacacttaatacctaaggcaagtggcttgcagtctcagcagattcctaaatgatgatctgccccatggtgatgcaaaagtgatgttaacactttcctaggaagatcttcaatggggaatgttcctttggcaatttgaatgcatcactatacttttccagccttttttcttcacctcacctaattttatgagttgtatgcatatctaaaataaaatgtgcatttagaattggccacatgtggacacatgccatgatatctcagaagacagtaaaaacgaacttgaaaaccagaaaaatgcacaggtcatatagggatcacttataattgcccctgcttttcccatggcattttcagtcccatcattattccatctacagcgcatctccaaagcaaaatatattatgaaaaagtcatgtatggtatttcaaattaaacaataacattttctaggtgcagagcaactctcgtgatatggccagttagacttttcatcttggtcttgccctttagatatactttgtgatgctggtggccaggtggcaagcagagaaggaggggcattctagaggcggtactaaagacagctcaaagctctagaaagtgtttaagtcttttattagaccactatggctgcaacaaaaggctaacctggttcctgtcctttctagctaaataagcccaaccaatgtgtccacagggcaaccagtgatataagaggatgatctgatttttatggtattacttccatttctgagccaagcatagcaaatatatagtttaactgttgtcagtcttcttcccttgtatttatggaagttatcattaattttatattgtagtcttttctgctaaacccaggcattgcttcataatctttcacaagatagcgcatgagagagctattgctgctgggtcagagttgttacatgagttgcatcttatctggccatctatctctgggctgagttacggtcacatttccctctgatagatctctaatatagcaggtgtagagttaaaggtctttcactttttctgggaggtcaccctgacaatagaagaacctggatttcttatcctatgtatagtttatcaccacggttgctcggcatgctcttttctggtatccctagctcaaccctaactttggtcatcattgtttttcaggttttcaatcaccttaaagttgccactgttccaaaagtcatttggtgagccattctgactgtttccactttgagaatctcgtgccaggtcactagagataaatatgcttattctggaactcccagacattaatctcagggtcaattcatggttctgtgaatgcttgataccaccatcagcactgtgaggcctggaactttgccatgactgctacctcctttgggctcaaatattaaggagataggggcagatactgggcctttgattaatatttctcctctgacgtacatgacccctttatcctcttcacttccttgatgttcctgggtgttgacatagatgaagatgatggttttccctatcttaagtgaaaaacaattcatgtttcgctttgggtagactgaatggcctttaaggattacagttgaagatagttttatccaaaaggtctcaacgcaaatcttttcttatagattagtctattaaatgtgaggggcatctctaccagagattctggcagggatggcaactttggttttaaatttgttagtcaataaatatttgagtaactactgtgtgtgtggtgccatgataatcactggaaatagtagcagtagctgaaagagtgagagttctcatgtagcttccagttatggaagacgataagctaagctgagaattctgctcctttatggccccttactaggaaataaattcgtgtgatctaggaagcccctgtccttctgggtgatgagtggaattcatctacacagtcttaccagtcttacaaatgtctgtcctaaaagactagtaacccaccttacccatattccaaggaaccttgaggcccatatttattatacatggccattatttgtatccatgattatataaacacagatgaattggtcatttcccctgtctgtgttctctactcttaaataacttagttctcctcccttgtacagatatgtgtatttttaaatctagaaatgttagtagttatagaaaaagctactaactgttttcactcttcttcccttttatttatggaagttatcattaattattaattattaattaattagttaacattaattaatgagataatctacattatctcagtgaattttcacactaaccctgtggagttatggttttaatatccaggtattatggtttcagaaaacaaagttatgcaagctcagtgatctctcccaggctggccagctactaagcggtagatccagggctcccacccacgtggtctgattctagaacctgagctcttaaccgctgtaccgacttgtatcactagccaacatctgggctgctctctgctttatcaatgagtaaactgaagcccaggctcttaagtgacttgtcaagttaacagactattcagcaacagatttgaattttcgtattaatatagtgtaaataacaacagttaaatcatttatagtgcttattatatgccagccactcttctaagtgctttttatattggctcatttacttaataactactggttattgtccccatttcacttagaggcaaactgatgctttctgagaccaagttgcttagggtcacacagctgccaagctaagcagctaagattctaactcagcctgtctagtgccagactttgtgttcggatttggtgattctcaaagagaagaagctttcttctcccactccaggagcatgtgcaatgcctggagacatttttggttatcacaactttgggggaggggagacctttatataatctagtggacagaggccaggtatgctgctgaccatcctcaagtacacaagatagacccttacaataaataattatttgtcctcaagtgtcaacagtgttataaccacctttctatggttataacacaccatcagtggcatccagcaaaagatttccaaatcaggaaagcagagagtagcctccagtgtccatgcttagtttagtgtgtcttttatcatgactgcaattctgggctggaatgttactgtttagtatgtacctcataaggataaagactagcattgtgcccagcaagagccaatgggggctcattaattattacaatggaagcacaaattggtgtgtttagatataggatgaaagaatgggaactcagttggagaaaatcataaaagtagcactctgatgactagtggtgatgattttggcttcagtaaagagaagtggccacattgttattcaaaaacatgatattttggataggaagaaagctgatgtttcaggcgttttctttttgtttaaacaaacctattttgcagattttgtatgccttttatcagtcatgcagctcaattacagtctgggcagcaagtttggacaaaaataaaaagaggaataaaaatatttttatacctacattgtatatttctcacaagagtttccaagtataattatccatgaatttcatccaaaaatcttcaactgtgtgaatcttacatttggttacttactggctaatcaggattgggcctaaatccagtgtatacattacataaagaggtgaggacagataatccaagcaaaagaaatttccttataaaattcctaaaatagtatcatttcagtatgggaccgatataaaaattattaatgggatattttacattttttctttgctgtctttgaacttggtatgtatttcacacttccagcacatctcattttggaaaagctataacaatgtttctgagacttaccatatttgagaaccatttccttagtctgtgcttttaaggaatgaagttgttggacgcggtgtctttttacctttatttgttgtcatagatgatgatgactaaaagtgtcttgtccaaatacaaatgtgaaaaggctgaagaccaagatataaatgaaatagaaggctgttatctactaaatgggctttttaaaaaaaaaaaacacttgactttaagactactaataaaactgtaaaataagagcatacttttgaaataagaacacatcaaacaaagtaaaactaaagtttagctcctttgtgtcccaggctgaaataaaagcatgtgggaggacctaccaatttatattatcaaagttaaatggacacaggtcatctttagcatacaggataaggttttagcatgaggaacactttatataaaaatatactgttttttggttcatgtgaaagatattattggccaggtgcggtggcccacgcctgtaatcccagcactttgggaggctgaggcggatggatcacctgaggtcaggagttcgagaccagcctgggcaacatggtgaaaccccatctctactaaaatacaaaaatcagctgggtgtggtggcgagcacctataatcccagctacttgggaagctgaggcaggagaattggttgaaccttggggatgaaggttgcagtgagccaagatcgtgcgaattcactccagcctgtgcaacagagcaaaactccgtctcaaaaaaaataaataaaataaaaataaggaaacgtattattaaaataggaatgacttactttttgtctcaccctgcttctttgtgtctggtactacggtatgatatgtcatgcatcttactagaggaagatgctgcctttatatgtgaagtggattcttatgacctagaaccagaacaagtgtgttaggcttcattttccaagcctcataatgaaatgccttgaagtattcattttcctgtccaatcttctttaaaaacaatatttgcacccctaaccgtaggcagtaattttgtacttctcagaccattgcaccaagtttgatttctacatgaagtttactattgtttgtgtatatggaatggcttatgacaacttcatttgtcctctgctctatctatcctaggtactagaatacctagggtcctagcagtccaatatgcctggattatgccaaacataacacactactggagatatgtatttgatgaacattccgtattcttttttggccagcttggcaagcaggagaatccgcagttagctcttcctttgaccagttatttctaagtgttgttgcaggaagtggcgcattaggaactagtctttttggtttgttgtgcaactagcacttgtgtaactccctctacctgaaccattgcctctcccatcagccagggtagcttaaaggaatgttgaggaaataaaaagtaggcataaaggtattgtgcatagtagtggggatatagatggggaaacagagggaggaagaggagtgactaaagagaaagctacatgtagtcaagtgttgtttatcagactctggtgtggatcacaatcgcctggggacgaattaaaatgatacattattgggattttacattcttcccaaagaggctttgatttactgggtttcaggttggaacaaaatgcattttatcaaggactacagttgagacactctgctgtagaggaaaggcaaactctgccctagaggaaaatgaggtatcctaaattccattttctggttcttcttcaaggcagaaggccaggactgaggttattttgtggcaaccacatttattgaatctccttccctggcatgtagctcatctggaaatgactttcctgtggaggctttgataaccttataggctcttaatttggattctggaacaggttgggataagaagaaaaatttctttcttgtgtttctagaaatgtataaactatatactaagcacagagtttctgttgggaatgatgaaaaaggtctgaagatggatggtggtgatggttgcacagcagtgtgaatgtacttatgccactgtattgtacatttgaaaagtaaatggtatttatgtatattttactgctatattatatattctatgtatactacaataataactttattaactcactacaacttttgagattattttagtaatctgtgggcatgattcctgatgaggacttcagtgaggcagacaaccatgaagactaactaactgttcatcaatttagaaaaaataagtttttgcagttgatttctctcttttaaaacttttaaatttcagcaaagatctgaaaaatgtgagtgatgccttcttcggtctcttaaaaaataaaaataatgtccgggcgtggtggctcacgcctgtaatcccagcactttgggaggccgagatagacggattgcctgagctcaggagttcgtgaccagcctgggcaacacggtgaaaccccgtctctcctaaaatataaaaaattaaccgggtgtggcagcgtgcgcctgtagtcccagctactcaggaggctgaggcaggagaattgcttgaacccgggaggcagaggttgcagtgagccgagattgcgccacttcactccagcctaggcgacacagcgagactccatctcaaaaaaataaaaaattcaaataaaaaaataaaataaaaataattaggatagcaaagcaggtgttcaacttgaaacctctctgtgttttcttgaagcttgaaacctctcagtttctgccttggatcagatgatatctttgttggtccttttctgacatgaggtgctataggtctacagtttactgagataatttacataacattttgatatggaatattttacctaaaatggagtgtgcaattcataattggaaggtatagggaggagtgtttaattgacttgatgcattcatgtgtcatgctcaaggtcaaaagcctcaagtatgtgagtactttgtaactggctgtctgtcaaagataccagggaattcaatctattacatgcacttcactgcactaaaccaacactacatgaagccatcagaacataggatggcctcactaatctcgctgcaataattactgcaggtgtctcctgatcatttaaaacaggcatttatattaggatgcattattctgttcaaatattagggccattagaattttaagagaatttcactttgaatatttgatacaaaagatgaaatgcttgtcaaactaatatatcctgcacgttctcagcccctaaacctaagactgttttcttggtacgaaagtatgcatatgtgaaacaaaacgtaagtgtttgtcgctgctcttaacttgtatctttcaccaacatctacaggagttgtgtagaataataagattagaacccttcaaagctttaaaaaccaaatctgggatttcaaaataaaagaaattttcatgggagagaggggagggcagtaattttgtaaagtacatttttaaaaggactggaatgattcattctttcagcgtgtgattgtgagtttgctggtgtggcagaaagactcttgttgctatggtatccctggacaatgttttgggcattggctgtcatagctgtaactggtcattttaagggggtgtcatacatgcattttgactattgttttcatgatgaagctggattgttttgatatatattctatttcaaattaaattatttaatacaaaaccctcttaaaaatgagcataataagtgaacaaaatagctcttttatggtaatggtaattttttaataacaggaagtgttaactattttcattccaactgttatttaatcattgtagaaagtagagaaagtagagggtcctttgttcttttagcaagaccttaatcttcatttcttcgttaaattagtttttttctttctttctttctttctttctttttttttttttttttgcatttccagctgccaaagtgctgtcactgatctaattttagtattcacacatatggagtagatgccagtcttgccttatttaaaaaaagtcttccagtatcgctaatacatatttttcccattggatgatatgcaaaattatgggtttttttttttttttttgagaagagaaatcctggtcaggacctggcttcccaaaatacccaagggtatgaatattgatgagattcctaaattggtgcacttttgctaatacatttactttctgaattctaaatttagtttctagctagagtccccattagtcctttctatagtttggcctctcagtgcaaggactgggaaactgtaaatgttaattatatttgcccttggacagttattaactctacttcccaactatcttcaacatattttttggtaagtcacagcaaaattgagttacatgtgtgaaatgcatcttaacataatagcaagagaatggttttcattgtagaatagacatgagcctgtatctcagcctttctccttatgtttgtatgacaattgggaatttatttaatgtctctgagccactgttccctcaaatgcgaatagtaatatctgccttgtgatgattacataaaacaatatatgtaaaggtccaggtagaatgccctataaacagtagttatgcactaattaataacttattattatcagtaattaattaattaaaaatctcttagatataggtgtaaattacaacagaagataataatcttttaaaatcaagaccaaatgtgacagagacagacctgaacttggccttgcagtgtcctggtccctcctgagtgcagagactattcctgctaatgcgaattccacctttcttttgccattcatgcagcattcacacatcacctcatacttttcaaaagagtttgatgaagtgggtatctttatctatattttatagccgacaaacctgaagcccaaagagaacttcgtcattctataagtggggacaaagttatacccagacccaggctctcctgattcctagtttagtgatattttactcgaccatgctgctcctagtgaattgagtcccttctttgttaagaaaccagagcacaaagagtcctattcataagactgaatttgacatttaaatttttggacatttttggcattttaattttcttattaaatgtaattaaccaaaatagaaaaactaagaataaagaaataacaaacaattttaatgcaagatggtcccctctgaagaccatatagggtgttcatggaggattttcaggaatttcctcgagacccatgaaattgcgtgttccatgttgtatgctaccagtgtatttctagggcagtgggcatatcagattttgggtctgtgactgcttctctaaacatataacaagaaaagataccatcaagcatatgagataagcagattgttagaacaagatactaagttgtcattttaagggtatcatatattattacatttcagaaatgcagagtcttacggtaggctgttgtgtctgggatctacagagaagactacatcagtcagaatgtgttaggctgcagaatacctaccttaaataatattttatgctatattactattacagtttttaattggaggcctgtagattaggtagttctaggactatctcagaggttcattcatgtcagcagtgacctaggttaattttttttttctttcttctctatgcttctaagtatcttcgcctttagttctcatgcatctcaaggtatggtctcaaaatgccatcattctatcagaatcacatcagggttgaaagtaaggaaaaatgggggaaagggatgcaccattaggcttctcttattcctgacacttttataaagaagggaaagttttcccagaaatcctcttccatgtaagactttccttgtagctcattggtcattcctagctttaaggtgtcaaagtacataagcatctggcaaggagaaataagattgctataattggcctagtccagtcaaaatccgtcactgtggtcgagctcattgctacttagatgagaagtggtgttctgttgtctcagaaaaaggagaaactggtagttagctaaccactatctctctttactgtgataattttgcacaaaccaagatgaattgactaagtttcgctctttactagattgagaaatacgtttcattcctaaaatatccaaatgtactaagacataaccatttacttaattctttgcctcttaagtatggcaattatttctaatattctacttttaaagttgaagctattcagactaagaaaacagtgagagattcattaagtaagtaacaaagttaaacctgcaactgatcatttgattttctagcaggtgctcattctgtcccatgttaattctaacagaggtcatagctgaacatgatgccttatttcttctttaatctatatacagttttatggactttgagtcttttatagccctaaatttttagaataactcttaaaaggaaaaatgcgccagattttcagatgtaggtttctcatacaattagaggaatattctaacactgggtcaacttaaagcctcattttgggatttatcagaatatgcaatctgctgtttggagggaatggccattttgcaaccagtttttcacctagtttatagaagctagaggtacattgtgtcagtacaaaaacaggccttccattctcttgatccattgtttcatatatatgggtgatgggctcagtataaaaatctaatgtttgaatttctgacatgtgttattagaatctactccctaaggtcttagtgaaaaacgtaaataacttttcactgtctaatttaactcatctgaagtctgcttatgaattttgcaggaggaggcacaagactgtattagtgtttatatgtgagataaaattgttgactaaaaatcttttaaagaaatggttttttacattaatttgctaatataagtatataccatgggactgacattgcttttcaaggttctataacatttctttgatgactaggtatatgttgctttcttttttttttttggagacagggtctcgctctctcgcccaggctggagtgcagtggcagaatctcagctcactgcaacctctgcctcccaggttcaagcgaggttcaagcaattcttctgcctcagcatcctgagtagctgagattacaggcacatgccaccacgcctggctaattttttgtatttttagtagagacggggtttcaccgtgttagcccagtggtctcgatctcctgacctcatgattcacccatgttggcctcccaaagtgctgggattacgggtgtgagccaccgcgcctggccatgttgcttatttttataaaacagggttattggatagttttacgcttctcaacagtgtaatttttctattgataaaattgtacaacttactctttttttgcttccttatcgcatcttgagactcttgtgcattctggagcaaggttgtagatgtatctcttaacttcacatatagtctcatttctgctcctgtcttaatattgtgacctttttcccacagtcttgtctgccaccatgagaggccaacagacacttacacccccacaatgtatttctctctcatattcttttgaaagactctaatagtctctaacccataagaacgaatgttacttcttacccacttgagatagtgataaaattagacctggcctgcctctcgttttaggaatatagcatacttagagttatgcctgtttgcacagcctctgaagctgaactgaggaaagtttaataaatccaatggtcaatcaatagacaactatgtttgagacgtctggtatatgtaaggtttgggactggatgcttcgagagatgaaaaaaggacaaaatacagcctttacccttaagatgctgtcacatttccaagggaaaagatggcacatgttcatgaaaaattaactgttacataagactctgtatacattattggttgaattaattttgttgaatgaatacagctccagtaagaacacctataggaattcataggagggaccaatcattgtgagtcaaagaaactaaaaaaatcacagcacatttgatttggaagaggttatcgagttccccatcacccagatatgtaaagagacttctcaaactaagtcccagagagtgactgtgattttcaaagagctacaagcttttattgacagaaccagtatttatttggagagactgatagacttgatttattcaggaaggaatggagaaaaatcctaggtggaaaagaatatgtttatttgacagatgtatttggaaaaaaataagcatttatctatggaaaggagagagttaaaaaatatggttaagggctagccttctgcttcttgccttttattttccctaaaatgatagcatgttctagaactaatggaataattttttttccttagaagtgagtggcatctgtgttttctctttttaatggggaaaaattattatttcccttccgaaatagttaattcaaggaatagtgcccttttaatcttatgattgtcctccataaatgttaaacttgtaaatcatctggctttgttgaattggaggccatctgtccctccagaggtgcattggttcacagtattccaaaatgaggtgatcatggcatgtgccaacgggaaattaaaaaagctctcctctaaatgttctaagcatcaggttatggtgtcaaaatcatttgccaatgaacttttcattaaccttgcctgaatcttgtattagaatcatgggtcttagcttctgagcacatttataaatgccttattttcgtcaaagctgtatacaatacacattgtaaaacctagataaaatgctcagatgtggcacaaaatgtgatctgagtaattttgacatcaagaatcccatagatgtgaagtatttctcaagctacctagaattgtaaacaagagaaggactcttgagtttaaaaatgttctccccgaaaccccatctctactaaaaatacaaaattagccgggggtggtggtgcacgcctgtaatcccagctactcagaaggctgaggcaggagaattgcaacaagagcgaaattccatctcaaaaaaaaaaaaaaaaaagttctccccagctctccacctgataaatcaaagacaagtgcttttcttttgttgttgttgttgttgtttgttcattcatttgtttttgagacagagtcttgttctgccacccaggctgtagtgcaatggccccatcttggctcactgcaacttccacctcccgggttcaagcgattgtcctccttcagcttcccgagtaactggattacatgcatgcatcactgcacccagctaagttttgtatttttagtagatatgggttttgtcaagttggccaggctggtctcaaatttctggcctcatgtgatccacctgcctcggcgtcccaaagtgctgggattactggcatgagtcactgcacctggcctcaaggacaaattttacttacatggtaagcaagattattttggaaatgatagaatgcaataaaggtgatagataaccttagagaaaaagttgaaaaaggaaagaggcagaggcaatgtagggccttgacaatagaagcaataaataaactagaaatgaatccttaagcaggctccattgcagaagaaatgcaagatttctcccagaaaaacatttgacattagattcctctaattccaacataaggaagaagttgtagagagaaccatagaattttataggtgaactaaaagtataagattgtctatttttattctttcagcttctcctgatttttcttgtaatgtgtgcatgaggggtaggagtgtggtgagtcaataagtgattaaattgaattgaaagactagcatagtcggcagggcgtggtggctcatgcctgtaatcccagtactttgggaggccgaagcaggtggatcacctgaggtcaggagtttgagaccagcctggccaacctggtgaaattccatctctactaaacaaaaaattagctgggcgtggtggtggacacctgtaatcccaggtactcaggaggctgaggcaggagaatcgcttgaacccaaaaggtggaggttgcagtgagccaaaatcgtgccactgtgctccagcctgggcaacaagagcaaaactccatctcaaaaaaaaaaaaaaaaaaaaacacctgccagcattactctcctgctgtactacgatagcatcttcactagtctccctgtctctaactggcttcctcaattccacctggactctacctcactccttgccactttccttcttctctactattccataccttttatactagccattgtaaagttaatttatttgccccaaagcagtgtactccaataatgtagctgctagccacctgtgtctgtttacatttaaattaattaaaatcagataaaattaaaatttcagttcgtaaattatactacccttatttcagattctcaatggccacttgtagctgatggttaacatattgaattgcaccaattttagaacatacctatcaacatgcctgtcattgcagaaagttcagctgggcagtgatgcttcaaagattagtggtctcccttgcattcttctcataagccagaaagttactggggtaacagtatacaacatttgccggccaggcgcggtggctcatgactgtaatcccagcactttgggaggccgaggtgggcggatcacttgaggtctggagttccagagcagcctgaccaatacggagaaaccctgtctctactaaaaatacaaaattagccaggtgtggtggtgcatgcctgtaatctcagctactcgggaggctgaggcaggagaatcacttgaactcgggggaggcgaaggttgtggtgagccaagatcacgccactgcactccagcctgggcgacaaaagcaaaactcggtctcaaaaaaaaaaaaaatattgccaagtcttcctcatttcccttctggtttcatatgctaaggttccttctgggactgtctgccggggtgtcatctcctttttcttgccacctcactagcctgccttaactttgtttagataccctttctatgctgttctttttacatagggcttcccttagcacagcatttcatcacatatatcgtaattgtttggtttttagtctctaccctccaccaaactctaaagcagtatttcttgctcttgctcttgctcacgttcatgcttggggcatgcagcttaatgcctagcacttcttgaacactcaataaacttttgattaattagtgaattacttaaaatgtttattcagaataaacaggcacacctaatagaattaatgcatttataatttatatgaacttaagccttttaaaacatttcgctttcattataaaactagaaattaatttcttcagacattgcccttaagaaaattactctaaggaatgtgtaagttatgtaaaatatatttaaccctaaaccacacaatgatgatgaaggtggtggttgtagtagtaataatgataataggaaatgtaaggaaaaataaggcagtctcacaccctattaagaaggaaacaacatttagaataagcctactttgtgtcaagccatgttagaaacccattatttaatataattagtacaaatcaactgttttcttttttctatgttgcctccaacccttgagtacatgaatgcataattttccacttgaatccatatctcaggtagtttatatttgtagttttagaattaatatttcattgtaggtatccaacatagtataattatttttaatgactgcatgatattctttctgtgaagacagtatcatttacttagaaactctctgattaccttttagacagctaaattgtttttaatctttcatattttaaatagcaatgcattcaatattttcatgtaaacagtttttcttaatgagaaggaggtattttaccttaagctgaattgctttggtttaaaaatatgtgagtttattgaaacattttgccaaatatttcttcatactgttgtaggcattgtcatcattttaaattctttgttaatttgacaggtacgaaatggacaaaaaggattttaaagttgtatctggggtgggaaatatgtctcaaaacacttggagataactgctatcatgttgaggaagaagtccgttcaaagaagaaaaggatgccatttgttttacttagttctttaaactaaagcactaacctcttttacaccaaagttaatatcccctttataaactctgagttcttaggtgttcttactcaagagggtaaggatatgacattagtgtcacatcactctatgtggagtaggatccagtgagcttaggaacccagaagaaacatgtattcacagcttggctttgatagaagcaatagactgattttcatttgctctaagggtgttttacaatatgtttcatttcaaaatgtaacaaatgatagtgcacagatgtttaaatcttcctgtatacattcccttctgccaatctcccatgtcagttcctttttattgatgcttatttttgtttgactgtttaattgccatgatttaagctattggtggttcaggatgcacttgcctgccctatattaacaacagtaatgcaaaaataacaacaataataataatgcctgtttattgagttttctcaaagatgagaaaactgagtcacagatgaagtaacttgtccaaaattgcactgctattcaaacataggcagtctagtctgaatttccagctcttaactcatatgctctacacagtggatcagggttcttttgtttagtatttcaggtagttataggtgaaattctgaaatactgtctgcaaaatgtataaaaggtgttcttgaggactggtttgtagttgtagtttgggaatacttgccaaatgctcacaaaatctgggtttgaaaagcatatggtctgagaagcagtctaaattcactccaaataagtcacaaaaaattaatatccctttttgttcatgactggtgggccagaggactcctttagggtgggactgctggccttcagcaagatatgcagcagcaactttaatggtatccttgtggaaattgtggatgacaatgagtagttcaggtgattttgtgggcttgcactttctgatgaaaccagaggcagagtaggttaagtacatggaagtggagtgagccaatgtcagttaagattttggcgtttccactgcaggatcttgagtacatttttgtttctctaaaagtttcacattcttcctctctgctctagggatgctaatgtgcagcattcaccacctgatagctgtaaacataaaaatggggtcatgtatgtactatgtttgcatggcacatccatacaatgttatactgttcagcaataaaaggaacaaagcactgctacctcttacggcaagagtgaactcagaaacattttgctaagtcaatgaaaccagatgcgttgtatgattccatttatatatgtccaggaaaggccaatatagagagacaggaagtagaatagtagttgcctgggactatagatgtgcgtggaggattgactgcagagggtcctgagggatctccttggggtaatagaaatattctaaaattggattgtgattatgattgtgctattctttaaatattctaaaaactccttgaattatacacttataacaggtgaatttttatactctgtaaagtataccttagcaaacataaaaaaagtagtcaataattgttggtatcattttattttttattattagtctttattgttcatataactgagagattctggggatgtgctataggaccctgtatttgaacttcatcaggattttagctactttttggatgacaacatgctttcacatttgagaatgacacagctggaagggataactaatggcttagaacccctaaccaagattggaattgttttgacagcctaaaaagctggttgaagcccataagatgaaattgaacaaaaataaatgtaaaatctggcacaggctgggttcctcaggcaagcaaaagaggtttaagcagctggcttctaaagtagctcttgttcttataagaaatgtttgtgcctctcagaaagggagtggcagaaaacctgggacaggattcaggccaaaactgaaggctccaactataaatgacatctgaggtttttgttagatgctggaagagttacttagttggacattccatgttttatgttcatatactaataatagtaattattattatatttataatgataaaactccatgcttcccatgacataagctctgtggtaaatgctttatatacattatctcattcaacaattataacaaccttacaaacagaatatttttatcctatttacatatgcagaactgagtcttagtgagcctttagtcaaacagctagtgaatggcagcccagttagaaagcacctagtcaggattgagggcccatattttcaactcttaagctctatcttctacccttagaatttcttattcacagaatatagttcttgaaatctagcaaagtgaaaattcaaaagcaaagaagtacatagtctatgcattttgcggggagaacacagatgattttaccaataccaagattggtttattttcgctctaatcctttgggagggactaatttccatcactgagttctaaactgctacgtctaatgagctgtgcgaaaatgctgaggtattgcaggctgtggccattcaagcaagaaggcagtaagctcagtaggaacagctgcttaataaaaggctattagtaggccagaaaacaaacaggagattttgctgaaacatataatctatttttaaattactttgaaatagtcacttgggcattgatacagaggaggattatcaacagtcggatggtttatagaaaataccttgaaatagacttttagatatttcctattttatcttcaataatctaaggagggggaaagggcagtcaccatgtatttatgaaaaataaaatagatgatgcgttgacttgaaaccttttcattttaaagaaggaaaatgcattctacaaagtcagaaaagtacatttttgatgttttcttatttcagagtgtcgcataatgcatatctttgtctgagatgtgctatagatccaaggatcgagggctagaagtctaccttctggctcttttatagtgtgtatgaataccatagaaatgctctttaattactttttaaaataataaatgaaatatgtgagttccgtgatacatagttgtcttttctttatctgtttgttttttttttttatttccaacttttattttaagttcagaggtacatgtgtgggatgtgtaggtttgttacataggtaaacatgtgccatgatggtttactgcacagatcatctcattacccagatactaagcccggcatcagttagctattcttcctgatcctctccctccgcccacacccgtccctctgacaggctccagtttgtgttgttccccaccatgtgtccctttgttctcatcatttagctcccacttataagtgagaacatgcactatttggttttctgttcctgcgttagtttgctaaggataatggtctccagctccatccatgtccctgcaaaggacatgatctcattcttttttatggctgaatagtattccatggtgtatatataccacattttctttctctagtctgtcactgatggacatttaggttgattccatgtccttgctattgtgaatagtgctgcaatgaacatatttagccctaattatattatatttatactttaatttttactatataatatcttgatcacagctttggcaaaaggctttttttccttttcacaccaatgagagaagcttatcttaactgcatattctcttatttaagctttttccttttcccagcaggactttcatctttgctcattctttccatctttctgtcactttggcacagtctatgactagaaagcatcaaccatttcaataatatttgttttgtttctccctttaaatatcaaaaaacctatataggtttgcttttttaagagaaaaaaataataactttatctgttgttaccatttctatagccttttatctttttgacccaggaaacaagttacttgtaaaccttttttcacttaactaaacaaatgaacatttttaaaatttaaatttagctcctactgtgagaaaaccttttaaatggcttattttcaaggcataagtctaagccctggcagccagcctgcgaatgtaacaaaccacacaactcatgcgccttgaaggtcaccataagtgaacagaatgtagaggaagggtcagcccataaaagggaagaaagtttcgttattgggaaattgaaacttaagcggggaagggaaccagggtataaccttataagggggataatgaaacttacgcgatgcccgggaagattgtaaccccatagtactcaaccagtgaggaactgggggagggacttgcatgctaggagataaattacctgctgtagcttccctgggtgtgcctgtctatcagacaccagatcttgcaatactgccattaaaagtcttgcttccgctgttcttcatggctctgagtccattctttggatttggacgggtgagcgtgtttctcacactaccaaaattagacaaacacattacaagaaaataaaactacaaacagaaatttctcatgaatgtagaagcaaaatcctctacaaaatcttagcaaattgaatcaataatgtataaaaataattatacaccaccaccaccaagtgggattcacatcaggtatccaagggtggttcaacattcaaatatcaattaatgtaattcatcacatcagtaggctaaagaagaaaaattagacagttatatcactagatgcagaaaagcatttgacagattcaacactcattcatgataagaactctctgcaaactaagaatagagaagcgcttcctcaactttgataaagaatatctaaaaaaaaccctacagttaacatcatacttaatggtgagaatctcaaagttttcctaccaggatcagaaacaaagcaaggataacttctaccactgcttttcagcatcatactagatgtttttagctaatgcaacaagacaagaaaaagtaaaagtatacagattggaaaggaagaaattaaactgccttttcttgtagatgacatgactacctatgtagaaaattccagaaaatcaacataaaatctcctggatgtaataaataattgtaaccgagatgcaggatatcattgttaacatagaccagtaaatgactgactttcctgtatatcaacaatgaccaactggaacttgaaaataaaaacataataccatttatgttagcacgccaaaaatgatatactttgatataaatttcacaaaatatgtacgaggtctatgtgaagaaaactagaaaactctgataaaagaactaaataagtggaaatatatttcatgtttatacataggaagactccatattgtgaggaggtcagtttttcccaacttgatctatagattcgatgcagtcccaatcaaaatcccagaaaggtattttgtggatatgtacttattgagtctaaagtttatatgatccaaaatagccaattcagtatggaaggagaagaacaaagtagtcaattgaatgactctactcaacttcaagaaatgctgtatagctacagaaatcaagacagtgtggtattgttgaaagaacagacaaatagatcagaacagagagcccagaaatatatccacatcaatatagttagctaatctttgacaaaggagtaaaggcaataaaatgaagaaaagatagtttttttaattctttctttctttcttttctttttcttttctttctttctttctttctttctttctctctttctctctttctctctttctctctttctttctttctttctctctttctctctttctccctctttctttctctctttctttctttgtttttttgaaacagagtctcgctctgtcacccaggctggagtgcagtggggcgatcttggctcactgcaacctccacctcccaggttcaaatgattttcctacctcagcctcctgagcagctaggattacaggtgcacgccaccatgtccagctaatttttgtatttttagtagagatgtggtttcaccatgtttgccagactgatctcaaacttctgacctcaagtgatccacccgcctcgacctcccaaagtgctgggattacaggtgtgagccactgtgcccagccaagatagtcttttcaataaatggtcctggaacaactgaacatcaacatgtaagacaaaaacaaatcaaaaaaagaatctagtcactgacttaaaccccgcgcaaaaaaattaacccaaaatggatcaaagaccgacatgtaaaatttaaaactgtaaaacctcttgaagataacaaggagaaaatctatgatatggtttggctgtatccctacccaaatctcatcttgaattgtaatcacataatccctatgtgttgtgggggggaccttgtgggaggtaattaaatcatgggggtggttctcctatgctgttctcatgttagtgagttctcaaaagatctgatggttttataagcaactggcatttcccctagagagaatgctagcactcattctctctcctgccgccctgtgaagaggggcctccatgcctcatgccatgattgtaagtttcatgagatctcccctgccatgtggaactgtgagtcaattaaacttcttttctttataaaatactcagtctctgcatagcagtgtgagaacagactaatacagtaaattggtactgcagagagtggggtgctgctataaagatagacgaaaatgtgaaagcgattttgtaagtgggtaacagaggttgaaacagtttggagggctcagaagacaggaagatacgagaaaatttggaacttcctagagacttgttgaatggttttgaccaaaatgctgatagtgatatggacaatgaagtccagtctgaggtcatctcagatggagatgaagaacttcttgggaactggagcagaggtgacttgctatgatttagcaaagagactggcagcattttgcccctgccctagagatctgtggaactttgaactttagagagctgatttagggtacctgacagaagcaatttctaagtaacaaagggttcaagagaaagcagatcataaaagtttggaaaatttgcagcctgatgatgtgatagaaaaaaaaaaaccattttctggggagaaattcaagccagctgcagaaaattccataagtaataaggagctgaatatatcaccatgacaatggggaaactgtccccagggtatgtcacagaccttcaggacaggccctcccatgacaggcccagaggcctagaagggaaatatggtttccttgaatgggcccagggaacccctgctttatgcagcttagggacatggtgccctgcatcccagccactccggccgtggctaaaaggggccaaggtacacacagggcatggcttcagagggtgcaagcctcaagcctaggcagcttccacatggtgttggtcctctgtatacacagaagtcaagaattgaggtttgagaacctccacttagatttcagagggtatatggaaatgcctggatgttcaggcaaaagtttgctgcagggacaaagccctcatggagaacctttgctagggtagtgtgaaagggaaatgtggggttggaggccccacactgagtccccactgtggcactgcctagtggagctatgagaagaaggccaccatcctccagaccccagaatggtagatccacctacagcttgtactgtgcacctggaaaagccacagacactcaatgccagcctgtgaaagcagccaggaggggtgctataccctgcaaagccataggggtagagctgcccaaggctgtgggagcccacctgttgcatcagtttgacctggatgtgagacatgggagttaaaggagatcattttggagctttaaggtttactgactgtcctattacattttagacttgcctggggcctgcagccgctttgttttggccaatgtcttccatttggaatgggcgtatttacccaatatctgtacccccattgtatctaggaagtaactaacttgctttcgattttaccacctcataggcagaagggacttgtcttctctcagatgacattttggacttggatttttgggttaatgctggaatgagctaagactaggggctattggaaaggtatgattgtgttttgaaacaagatttgggaggggtcaggggcagaatgatatggttttgctgtgtttccacccaaacttcatcttgagttgtaatcccataattcccatgtgttgtggaagggaccccttgggaggtaattgattcatgggggccatttccccaatgctgttctcatgatagtgagtgagttctcatgagatctgatggttttataagtggcatttcccctgctggcatgcattttctctcctgccaccctgtgaagaggtgccttctaccatgattgtaagtttcctgaggcctccccaaccatgtggaactgtaagtcaattaaactttttttctttataaaatacccagtctcaggtatttcttcatagcagcgtgagaacagactaatactgtctagatgactttggatttggctatgatattttggatatgacatcaaaggcaagatctatgaaagaaagaattgataggctggacattattaaaattaaaaatattttatctgcaaaaagatactgtcaagagaatgaaaagaacaaccacaaactgggagaaaacattggcaaagacatacctgataaaggactgttagcaaaatctacaaagaactttcttaaaactcaacaatcaggaaacaaacaacaaattttaaaaatctgttacattaacagatattttattgaaaaaaatacacagacagcaaataattatatgaaaagatgctacacaccatatgtcatcagagaaatgaaaataactatgagatactactacatgcttattagaacaataagccaatcttggaacacagacaacctgctaacctgataagacagtaagtccaattctattgctagacaacattgctcaatgtaaaaataactcatggtttgttaattgcatcggcatgaagaggaactgcaaatggcctatgaatactagattgtgatgtgatgctttgggcttccctggcatgcagtgactcttataactgtgtattccatgtgaggaccctggaagcaatttatatggaattgctaaaggaaatactggctcctataggggatgaggcttgtaaaccagggtgacttcagcacaggaccaatgtgactcttgtctccttgtatctgaactgtcacccagaaggctgtgtcaacggctacaaggacatccacagtgaggaactgctgctatcctgctgacatgctgtgctcttgaactgtatttttctgtgtatcctgagcctattgagaggtgacagcgtgctggcagccctcacagcccttgctcgctctccgcacctcctcagcctctgcgcccactctggccatgctcgaggagcccttcagcctgccactgtgctgtgggggcccctctctgggctggccgaggctgagccagctccctctgcttgcgggaaggtgtgcgagaggcacgggcgggagccagggctgcaccctgcgctcaccggccagcgcgagttccaggtggccgtgggctcggcggcccgcactcagagcagcgggctggtgccactggccccgggcagtgagtggcttagcaccctggccagcagctgcagagggtgcgccgggtcccccagcagtgccggccggccagtgctgcgctcgaattcccgccaggcctcagctgcctccccgtggggcagggcttgggacctgcagcctgccatgcagagcctctccccctgtggctgtgggctccagcgcggccggagcctccgcagacagcacctccccctgctccgcggtgcccggtcccatcgactgcccaagggctgaggagggcgggcacgcggtggcacgggactggtggccaactccgcctgtggccccagtgcaggatccactaggtgaagccagctgggctcctgagtctagtggggacttggagaacctttatgtctagctaagggattgtaaatacaccaagcagcactctgtgtctagctcaaggtttgtaaatgcaccaattagcattctgtatctagctgatctggtggggacttggagaatctttttgtctagcttagggattgtaaatacacccatcggcactctgtgtctagttcaaggtttgtaaatgcaccaatcagcactctgtatctaggtaatctgggggggacttggagaatctttgtctagctaagggattgtaaatacaccaatcagcactctctgtctagctcaaggtttgtaaacacaccaatcagcatcctgtgtgtagctcaaggtttgtaaatgcaccaatcagtgctctgtgtctagctaatctagtgggtacttggagaacttttgtgtctagctcagggattataaacgcaccagtcagcaccctgtcaaaacggatcgatcagctctctgtaaaatggaccaatcagcaggaagtgggtggggccagataagggaataaaagcaggctgcctgagccagcagtggcaacccgcgcaggtgcccttccacactgtggaagctttgttctttcgctctttgcaataaatcttgctgctgctcactctttgggtccacactgcctttgagctgtaacattcatctcgaaggtctgcagcttctctcctgaggccagccagaccacgaacccactgggaggaacaacaactccagacaccctaccttaagagctgtaacactcactgcgaaggtctgcagtttcactcctgaagcccgcgagatcaggaacccaccagaaggaagaaactcggaacacagctgaacatcaggagggacaaaccctggacacaccagctttaagaactgtaacactcacccaccgtaagggtccgcggcttcattctggaagtcagtgagaccaagaacccaccaattccagatacactatgatagtcttatgtttagctgaatcaagaggaacttctagaaggtagtaaacatctgactagaacattatgatcaaaatagtgaaatgtttggatttttgaatgattttaatatgatagtgaaaaacagttgttcactaaagaccagataatttaacttgattcttatagaaaaatataatatttattgaagtctactgtgttaccccccggattcatagctggatacatttttaaaaaaattataagacactaaaaacccaacttaaaaatgaaaatttatacctgacaagtatttgttttgtcagaataccagcttggctgagtatttttgttactgtctccataaattttatatattttctgaataacatttatttgggtacaactgtaaaggaatggattagccttcatgtttgataattggagaatattgggtagattggtcatgttaccagaatgggcaaaaatggaccatttagagtgttgaatttaaagttagggtcctagttttctccaaactgttttttattaacttcaagattatataaaacaacatatttatgttatcttatgtatttgtgttcttttttaaaaaaaataagttaggcgatcctttctttatataaatcacatagaaatttatagcctagttgaaatgggccaccaaattcctgctaccttctccccactttttttctcatctagcagcttttgaggcatcactagggatccacaaagggcagtttgtaagaacactgctaaacataattattgtggtttcacacggtgtattttgccattggtagccaatttgttggtaaaattactaatgtaaaaataatttttagtgtatataaacatatcatttctgaccttgattcttttctctgcttatgtataagcatgcttatctttactgcaatatatttgctcttacaactattaccaattcgtagtatggagggttattgtttaaacttaatttaagaaagtaacaagaaggaaagccaccttttgtccagcaaccaaacttcccttccctccctttctaccatccaaccaatttaccagccaagcatttatccttccatccaccccacaacaattatttgttgccaggggatttagagataaatacataatcgttgccttcaaaaagccctagtcaattatattccttaggatactaccagcatttccaaatactctttagcacagattatttccttcaaattaaaataaaatgtgtgcatgactctttttttgtttgttttgttttgttttgtatgagagattgtgacttcaagaaagtttaaaagcctttggctagatactacattgatattgatctctttcttcttatacctttgtaatttttgaaatacatgagaaactgtcgtttacgctttcctttcattttccaatctcctattgtatttggcacatagagttgaaaggaaacaatattagcatttagtagcaaattaattttcgcagtaacaaatgacatgtaccaataagttatatttgttcatgaaaatacatttagagagttatattatgacttggtgaattttaagaccgaaaataaagagccaacttagcaaacctgtggctgatcaacacagattaagacacttctagtttctccctctttccattggtgtgtaccttaccaatcaacaccctcaaagcaattaaactatatatagttatccctaatacacatttacttccttgggcattagccagaatgcacattttatgatcacttatccttcaaatacaactactggtaattatctaagatgtttagatgcagaggtttgacaattagcaatcaaagttcatgtttgctaggaaaatgtacagcaagtcctcaaataacatccttttgctcaatgtcatttccttataagtttgaggggaaaaaatccattcctagctggagccattgtctgtatggagttcacacattctccccatgtcttgggttgtctctgggtactccagtttcctcccacatcccaaatatgtgtatgtttggtaaattggtgtgtctacattgttccagtgtgagtgagtgttggggggtgtgtgtgccctgtgtgagatgtcctcctctccagggttggttcctgctggtgccctgagctactgggataggctccagccacctgtgaccctgaactggaggaactgggtaaatcatttgttttgattaatctttcttaaatgtaagtatagcttacattcatctcaatgtttaatattaaatcttgtttatataaattagcctatgataaaattggtttttatatgtcatttcacttaaagtcagtttccaaggacctatcaacaacatgaaaagaggacttactgtgaacacatctgaactttcaaagcttgtgtagtagcattcaacggaaatgcataaacttctctatgcattagtacattaacattccctttaattgaaatgaatgcttacaagtgtgaaaagcaactaatgtagtgttatttaaattgaatgtaggctccatttttaataatagatagtctagaatcatagataaaaaggaatgataaataatacaatagagtccaaatcattcatctctgcatcactctacagaaacatgctgctttccatcagatattttttctggcatcaaacctctgtttttgcaaattacttttttttctgtgagtttttaatgttgaaatattttccacattagcatgtattgactcagtttactttttggtgcactattgaaatcactcaattgaacgggaacttatgccagtcctgagaggataagaaacttgttgaaaattatttttgccctctcaacaaaagacattagatttttaagtatcctagaattatcatgttatgtctaatagcagtcatcatagtgattaaggcttcccaggcctcaccaagatttgggtaacaaatgaagcaatgtagtagcttcgttcacccattttacttatttgaatgaaactggagaaaggctgggctaaaggaaagaagccctcactcccacacttaccctcttttttctcattcccttatgctatatttgtcttctttgccatattaaaccagaagcctcagccaaaatgaagagaaacacagaaggtatttcttagtttccaaagtacaatgttctgaggaattaagagagtttgaagagtaacttcctatgttcaatttggggagagttatgtagtaattttataacctccccactccaaaataatgctagtcataccagtatctgtcactcatagaaatgccttttctgcatgttaagtttaaaaaatgtttctatagggtgtgatgcttctgcttagaataagccacatatttagctgtgtgaaaagatgatggaatttagtctttttcttcttcccttcctttctttctactttcctcccttccaacattctctgttttattcaatttctctaaagaatgctggggagagcccagcctatcttgcctatttgacctttactctgaaaaggatgtatgtatgtctcgtataaaacatacagtctattctgccattttatatttttctacaaccactaataaccaaattgtaaataggggaatgtgaaagtcatatgaagtcatatattatcctatacagaggtttctgaaatagcaggattagaattattatctctaccaggaaaggaaaaaaaaaaaaacctctcaagtaacagccatatagacaagagaattttcaagtctgcttacaaaaaggaaaaaagaaaacaagcaaacaagcaaacgtgaacatctgcaccaggggcttttccccttgaaaggcacacgctcatctgagcatggctttctgccggtgtaggctgcactttctcaaagcctactgctttctgcaagaaactgtcacgcccactctcatggttttgtgtactttgaagtaccacctagttagtctccaactatgctcagctgcctacctaggttatccaagataatttcttagggggcactaataattgtctttggtaatgttcttgttatggagctgtaagagtttttagtggcctaccaaaaatttgtttttcctcataagccatattttggggatataattttacaaagagtaaagttgttcaaaaatgcatgtctccgggtatggtggaaatgcctattttatcctcctttatgctaatgcagaactcttttacagttttatatttgtgcactaagcaacattttgcaaacatggaaaatagcttgaacactggaatatatgttgcattataagtaattttgtctactttgtatgtattattaaatttatcttataggaaaaatctcaccctgaaatatggtcatgaattaaaggcaatcaactttcaaatcacgcccaccctttattttctcattcccgtatgctatacttctcttccttgctggatgaaatgagaaacttcagctgaaatgaaaagaaacacagaaattatttcttagtttccaaagtactatgtttagcgaccaagatgctgttattcaggcctcccagttgacagaatgacctagatctagagatcaagataccaccttctttagtgtatacaaatttccaaataaagaaagaataggggggaaaaatcagtctttccaggagggtagaatcttctacatgaaagcaacaaatatacttcttcagagcctaaatcaatctggaaaaccaatagaacaagacatttaaaagtgtatattgtgcctaatatatctcttttctcctccatatcacccagcacatagtacgtactcagaaatgtctgtaggaaacagcttattgtgaacaaattcacccccaaatgtatgaatttatgattatcaatagaaataaagatagttgtaagaattgaagaactgaattacacaagagtaatagattgaaaatttttatatgagcacagtctccttaccagatgccttacgctctaatgggtcaacaattgacatgaaaagaaaaaatacacgtgtatagatagatatatgtgtatgataaaatgtcaactgctattgaatctaaattttgggtgtattggtgattattatacttaaaaaatatttttctgaacgtgtaagcactttcacaagaaactaggagaagaagtattgttgcataataagagatgtctaataaaagagatattactgtgaaatcttttataggccctcacaggctgcaaaaatcattttcaaacttgtattatttagtttcaactatcctatccaacctgtattttcgtgtgtagttcaaatctctttaattatagttttcatatttatggcctttgatattcagtatggtagaaatgcccttaaagacatatatagtctcctaatttaaatccttcagtaaaactagaaatcgacattttctcgaatcttccgtcaaggagcagactgcctgccgtggttttattgcagtctggtgctttacaccactttcttctctgtgattatttgtgagtcattttgtaagtttttactttgtttcataaatctatactgtaaactttttaggcaatgattatcttaagtctttgtttttttttagttacctgtgaatcagaaaatgagggaatttagactatatcacattgttttgattttgatttatttaaaaaaaatctatgcacctttctgcatttattcaataataactcgaaataataataataacttgaaatctccctgaaggcaggaaatgttgcctcctgcgtttctagcacagtggcttttatacaatggctgcttagtaaatactgttgaattttgatgtaaaaggtggcacatgtaccttgcagatattttgtactcttttattatagcgcctgttttatagcatttgtgagcccttccttctaaacgtgtcccaaatttcagagagattggagtttgcgatagtgggtcagatttttgggcttagtcctgcaggcttatcatggatctggggcagtaatctaaagacattggaactgagatgtcatacccggttgacaactggggctctaattcaggtctgcgaggcctcattctctcattgacagaacgagagagcagattctacttttaggtatattgttttggagatccaagagctgggagcagccatttcttctcatcttccttttccatatttacagatacgtaggtgaccatgttatctgtaatagatattttttactctttgttgaaataattgggaagaaaattcttagttgtttggcttattatcaaattttcttagttttttatttaatctatttttatgacactttggatccttctgtttaagagactgcaataaatgaaggagaggaatgaagcaaataaacttggattagctgtctttgttgatatcgtttaggaagaaccgcatgccagtaccctaattaacaaatacatggtgtgatagtttatagttcaaacagtattgtctaaagtcgttttaatctatcaggtttttataggaagataccacaaagacttgatggtacagttacacagatttaattctatgaacataaaaaaattgattttcctgggggcattaagaactgtttttattgattgaatattttacttgcataaatggtagttcttaaaaacagctgcacattttactgttagtatctgaaagttcttaaattgtaggcgtaaatgtttcattttaattgtgcatttccatccttcaacccaagtaacaagaagataatatagagagtgtgtcatactttttctgggtacaaagatgataaagttgctgtccatactctcaaaataacttctttcttattccttttgtttctacctgctctaagataattgactcaatgggactaccctaatactcttgcagaatctaaactagattatactggacattggaagagtttacgtatcagaaaatgccattcctccggacataaggtagtgagataatattttagcttcttcaggaaaactttcctgaaacctcaaagctgaaggatgtcttggaagcattcgcatttctggcctccctcattttacagggctggagatgcaaaccacacacggatctagttggtgtcttctcatgaactagaaatcttatttttagaatattcttccagtgatttctgccactatagttttattgttggtttgagcagttagtattgaggattcattttggaaggaactgctagctgccaaccaatatcctttatttctttgtactttaataatagaacaccaattttattttgggcaaccatgtgcccagataaaatactgtaattgctaacacattcacaactaatacggtcatgtggctaaattttgtccactaaccagaactattatggggagacttcagagatgtttctggggaaatgattcggctgggaattgtgctgtcatcctcttgttccttctttttgctgcctggaatacagacttgatgactggagctttagtggctatcttggaccaagtgatgatcttgaagatgaaaatgctattctagaatagtggcagagtgagatagaagaagcctaaatctttaattgatgactatagaactgttataccagtcctggattgtttattaggattttttttttttcctgtagtcagaaatgaacttctcttttatttgagctattattattttcctcttacatgttattgaaccaattattgatgaaagagagtcaaactctgtaaaatattggaaaggatttatgtttagccaaatataagtgaccaaggcctaaggcacagtctcaagagttccggagaacacatgcccaaggtggttgggttacagaccaattttatacattttaggggacagaagttacaggcagacatcaatcaatacatgtaaggtatactttggttttgtccagaaaggtggtagaacctgaagcatgtggcagggggcttacaggtaatgggtagatttaaagatttgctgattggcagtcctttgacagggttaagctctgactgaagagatgaggtcagcagaaggaaatatttgtagttaagataaggggccttgttgaagccaaggttcttgttatgtagatgaagcttccaggtagcaagctgcagacagaatagctggtaaatgtctcttatcagaccttaagaggtaccagactcttagttaaatctctcctggatcagggaaagtcctggcaggggaaggagattcactacagaatgtagcttttccccacaagaaacagcttttcggggtcatttcaaaatatgtcaaagaaatatatttcagggtaaaatactttgatttctttcagagcctgctgtctgttgtgtgatgctataccagagtctggttgtaatagtctgtgtggtcagtcttaagatctctgtgttaatgctggccagttgtgcctgaattccaaagggaggagagtaaaaaatactgtatgtatgtacaatatgttttccattaataatagtccttgttctatatcagggtttctcaacccaaagttcatgaatttcttgaggtattatgaaaaactatacttgtatatacattttttttcctacaaaggtagtccattaagtcctcgagagatctggatatcagagacagtgctcaaaataggaagatgatatttatctagagaagggcttcatctattgcagagcagctaaagtagaagattatttgaaatgccgccttcaacatcataatcaatatttaatagcaatctctgaatgtctaaaatgacaggccttcaagttcttatttcaaatacctcttcctctccaaaatatttttcaaattgccaagtaggaaataatatttcccttttctaatttcccataatactttaatacatactctcttaaaatacttacctgtgtgttttgaacttcttcaagttccttgaaagccaatatcacatctagaccaccattaaatccccagccatttacaaatatgacttattcaataaatccttgttggatgaataaattcctgaatccattggcttattttggtggacacactacacttttaatatggctcttgtttggtccccaatccccaggccatggacaggttacctgtctgtggcctgttaggaacctggctgcacagcaggagatgagcagcaggcgagcgagcattacctcctgagctctgcctcctatcaggtcagtggcagcattagattctcatgggagtgcgaaccctattgtgaactgcatacgagggatctaggttgcaccctccttatgagaatcttactaatgcctgatgacctgagggggaacagtttcatcttgaagccatactccccttgcctggtccgtggaaaaattgtcttccatgaaaccagtccctgctgccaaaaaggttggggaccactggttgaaaacataggaaacttcagcctcaaaagtaatttaataggaaggctccaaattggatccaggtttcagccactagaacatagcacagagaaggcacagatggcagtccacagcacctggctgaaacacagattggcctcttgtcttctgtccctaaccatccagatgatagatttatgcacaagcgggctcagaaaaattagacttaagaagatataaaccattttctacctgggagatatcagttgtcagcattctattttctgtgtagtagttataaaacaaaagaaagttaatcaaatgtttcctctggatacaaattctgatttgtcatgtcattccaaaatgtagtggcactgtaaaattctaccagtaggaaagccatttactcttgatgacgtccgatgtgcttacagtcgatattgatttaattctgcttggttgttgtttattagctcatttcatttttactggggtattggacatttttagatatgtcaggaaaatattgttttaggattttagggagcttaaaaacaatgcctctctttctccacaaagttcagaagcaatggggaaacatatgtaacagtctgatacaaataaaaatataacatttattatcgatgaagtgaaaaatatgacatagatttgttgaccagtagagtgctaataattcacccctgaattaagtggatttacctacccagttactttcacgcttggacaatttcagtctcctggagataggctctgtgatgggtggttggaaagcagaacagaaggcaccatttttgaaggtaagggtttcagaaaaaagaatagaagaagagctgagatgcctatgttcagttcccttttccaaagtcactaaggaaggtccaggaatgttgtcctaccattgtttttccaaatggaaatatgtgatatgggtaataagtgttcccttgtgttaaggctctccagagaaacagacccaatatattaagaggtcatttattgtgggaattggctctcacaattatggagactgaaggcctaagaactggggacttctcatagaagtcctggagtctgaaggcttgagaatctggagctctgatatctaaaggcagacaaagatggatgtcccagctccagaagagagcaaaattgcccttcttcagcctttttgttctgtctgggctatcaaggacccaggtgatgcctgcccacattgatgagggcagattatctgtactttggaaacaacgtcacagagacacccaaaaatgttttactagctatgtaggaattccttaacccacttcagttgacatattaatttaactatcacttccttcttctttcatatgtatttcactgtgttcctctgacactgtttgaaattttaagtgatgtcatcattttcttctcactacaacctttaatggacactcttcccctattgaatcacatataaagtccttggcacctaagattactgtgaactggcccccagtatctaaaatcaatacctgtagttcacatccctatagcattttcaccctcaaatgacttagctcattatgtagtttttggaaaatccagaatgtggtacattttcacacctactgttagtagttctcaccttgacttgtataatgaaccatttaatgtcctgtgctcatgagtggcaacctagggagacctaagcgatcttcagtaagaagaggtttgaggatttaggggtgggagttaagtctcataagatccaggtgaagttatataagcattgtggcatatgaaatttcatatattttgtattaatattgctgattggtgatgtgaacttatttaatgtcattttcctgttcttgcctacccgattgaatactaaagagctaaaatttttattctctcttatgacttttgaatcccttatagagcacttaacagaatctataactattgaatttacttatcaattacttatctgttatctttctccctccacgggatataaacctcataattgtcatgtttgtctagctcttcaatatgatcggcaccacatagaccataaatatgagttgagtgaatcctctcagttatttacttgctcacttctactctttttctctacctttccacccacccataatcaactattactaaaattagaaacaaatgaagtaatttcaaatgccttatagaaatatagtaagtcaatggtagtaaaaagttgtttatatcatgatataatatatggccaattcattgaatattactacttaatttcatctttatgtatttttgcaaatatatatgaatacttatggagtttgaatatatatgaggaatatatatggagtatgaatatatatggattttgaatatatatgaatacttatggagtaaatactgattgcatttatggcaacatattcattaataactgaaacctaacatgagcactgctgctaggttgtgtggtaattacagttcagttattttagaaattgctgaaatgttttccagagtgtctctatcattttacattcctcctagcaatgtatgagtgatgcagtttctccacatcttccctagcaagcaatattttcgctaatttttgtttgtttgttttagccattctttttgttgttgtcgttgttgttgttggagacaggatctcgctttgtcacccaggctggagtgcatgcagtggcatgatcatggctcactgcagccttggcctcccaggctcaaatgaccctcccacctcagcctccagaggagctggaactacaagcgcatgccaccacgcccagctaatttttgtatttttttgtagacacggggtcttaccatgtttctcaggctgatactgaactcttggactcaagagatccacctgccttggcctcccaaagggctggtattacatgtgtgagccactgcaatttttcctcttattgatggtgcttttttttttgagatgaagtcttgctctgttgcccaggtaggagtgcagtggtgtgatctcggctcactgcaacctccacctcccaggttcaagtgattctcctgcctcagcttcccaagtagctgggactacaggcgtgcaccaccacaccaggctaatttttgtatttttagtagagatagggtttcaacatgttggccaggctgatctcgaactcctgacctcaagtgtttgcccgcctcagcttcccaaagtgctgggattacaggcgtaagccactacacctggcttgatggtgcttttggtatcaagtctgagaactcgttgcctaaccctagatcttgaagattttctcttgcatcctctaaaatagttttatattttatatttaagtccatgatctattttgaattaatgcttgtagtgtgagatttaggttgatattcatttgtctctggatatccagttgctccaacaccatttgctgaaaagcctatccttctgctattatattgcttttgtacctttctcaaaaattagtttgactactaatggatatagagtttattttggaggatatgaaaatattcctgattaaataataatgatggttgtacaactccattaacatactaaacagaatctataattattgaatttactaaattgtatatctaaagaggtgaaaattatggggtgtgaattacataccaataaaactgttatttttttaaaacttgggtggatttgtattgggtctatttctgggttccctacttgtattcattgatctatgtgtctgtctctctgccagtatcacactgtcatgattaaggtagctatatgtttaagccttattactgggtaaattgatttctctcatattcttcttttttatctagattgctttattctagggtgcttatctttctatataaattttaaagtaagttttaaaatgtctactaaaaccttacagggagtttgataagaattttattaagcccatatatttctttggggaaaattgacatcttttttacattgacccttccagttcatgaacctggtatgtctctctgtttacttagttcttcttttatttcttccattgtcatttagttattttcaatatgcagatcccatgcaagttttgtgaattttgtactgaagtatttcatttcctttggaatgattttaaatggtattatgtttttaattttgccttttaatatccatttttaatgtatacaaatacaatagattcttgtgtgtttatcttatgtcaacatcctacagtatcttgcaatattgctgaactcaacctttaaatttttaaggtttatgaatattggactttaaaagttttatattaattagtatttttatcttcccctgaataataccaggagtttaaaatgctaacttgaatcaccttctttctgaggcccattaattgcagcctagtattttagatttgccttcttttcacccttaaaaatccttattataagtgttctttttgttgcttttttagtcagtaattgtgtagatttctcaaagtgttattttagcttctaagatcatcattctttaattaacgtttacccagataaaagtataaaattatattttgacacttattttttcttaagtgtttgaaaatagtattattccattgtgttcttgcccctcctttctaatgagaattctgcatacaatctaattgttatttctttgtaaatacttgctttttgtttctggttgctttttaagatttttctctccatcttgggtatccactggtacactaatatgattggttactttaggctttgtttttattaaaccttttcaatgttcagtatgtttcttttttttctgaagacaacttttgatataattcattcttaaacagaatctatttgatatttaattgtcctttgagtttttttcttaattttttctattgaagtataaattccacatactgaaatacatagtcattaagtgtgcaggctaatgagtctttgcaaatgaacatttacctgtgcaagcatcgtatttgtcaagataaggaacattttcttccctgcagaaagttcctcatgtcccactttttcaagtcctcttttttcccccccgcacaatgtatagattgttaaaattgtactctctgctcttagatttttataatgaatttaaatatgtattttatatctttcaggttcttccattatttttaggtttttgcatgccagttaatacttgaaacttctgtttgctcctgatgatggttgtcattgcatggtgtatttttagcagatttttttgttaactgtgggagacccatatgctcaggaggatagacatgtccctatatagaaagtccattcatttttgtgaggtttcaaatggatttgtaggagtttgtctagtttttgtgttaacatttcaattccggattactagaccaccactaggaagtgtaaatttgggctttatatctgttcagattgaagttacatttgttaacagattttaccctctgtatccattttctattgctgttgtaacaaattattaatatcacaaatttcatggcttaaaacaatacaaagttgttctctgactattctgcaggccagaagtctaaagtgagcctatagggctgagttccttcaggaggttctaggggaaaattgttttcttacctttatcaacttctagaggccacctgcattccacagcttgtggcctgttcatataaaaagctagcagtgtaccatcttcaaatgtcactccccaccctcacttccgttgtcatattaccttctgtacctgtgtatttgatcctctcatatccctctcataaggacccctgtgattatattgggcccacccatataatctaggataacatcccatgttaagatctttcagttaaatcaatctttaaagtccctttcactgtgtaaagtacaggcggagcattcccaaatcctcccaaatctgaaactttttgagcctcgacataacacctagattccaccatttaagcaaccacgcattgtccacatgggtgcatgagatcctgacacctttgctttctgatggttcagtgtacacaaacttcatttcatgcagaaaattatttaaaatattgcatggaattaccttcagactttgtgtataaagtacatataaaacaaaaattaatttcctatttatacgtggatccaatctctaagatatcccattatgtatatgcaaatattccaaaatccaaaaatttttgaaatttgaaacacctctggccccaagcattttggataacagatactcaatgtataatatattcatagattctggggattaggacttgaacatttagtggggagcattatttagcctccaaggcctcctttctccaaattttagagatactccacttctttaacacttcatgtgctaagggtggagttttactatccacgtgtctcatggtgcattcctctagtatcccagttttaaaccagggttttaaagtttttgcttcatgtctcatctgtctctgcagtatattcaaattcacttgcagcccccagaggtactttcttgcacaattccaggaagtacatttacattagatagtacatgaatggcacctcctacagttgtgtagcctgacactagagccagcaatcagggctcctgtctctatgccttccatccaccatcagtggatggaaccttactactctggcttagcacttttgtttttcaagctcagctgtaaacatgtgaacaggtgttcacacataattttgttatttttctttccttttgtttaaccagcattttcgtggctgtaaagagagaaggcttagtccaccatattgttggaactttaccttcattttacagaggaagaaagggctttccatatgagtgaactgacttatctgaggacacgactaataaattaccgaatcacagctagaactttggtgtcctgactctgacacaaaagttcttttataaatcttagtaacagtgcttttattatgattattcctgttatcactgatactcattactaacttcccaaattacacaagaacctgatgaaaactatactgttgtatgtccttgtgaaccgcaacacatatacaataaaaattcatttattactgaaacatttttggagatatatcattaagctaggtgataggtatacaaaactgaatgagacatgatatctgccatcagggtgtcatagtctaatagaagaaataggtgcataaacagatagttacaatgcattgtgcccaagtatcatttgaactcaagatatagttaagctgttggggaaagtgggattgattagatggggaggagagagaatgggttcaggatgtttaatcttcaaatagttattaccagatagatggctggataggattgagggatgcatagatggatagttatatgacaaagcaggcatagtaagatattagttgtagaatctagaaaggagatacacagttgctcactgtatcagtctttcaacgtttgtctatgttcgaaaattttataataaatggttggggaagtatcgtcttcatctttattatagctatcattcattgagtgcttagtgtgccaggcgtctttaagagctttacatgatttagctcatttaattcccatatcatctgcaagataagtactatcattatccccattttacagaaagttgggcatagagaagttaagtaacttgttcaggctcacacagttagtaagtggacaacccatgataccaggctgtctgactctagaattttcactcttaactttgacagagctatctctaaaagattgagaggatttttttttaataaagtgggtagggatgaggaagcattacaggcaaaggagagaatatatttacatagataggaaaaatagcatggatttttcaaggcaaacataatcctgggtggtgaatggaatataaagcataaatcattgagcaaaggaggttactggggggttgggaggactctgtaagaactggccatatttggctttaccaggtagctgagagggatccactgaaggatttttaataggaggactgtgtgtttagatctctattttgaaatgggagctctgatgtcagtgtggagaatggatttcaactaaagcttttctttttttttttatttccaggtgaaaaatgctagaacaaaatagaacagtttagagatcaataaatggtacaagtaaagtgtctggaaggagctctctgcttccttaatagagagtgcattctgcagaagttgaaagtgaccctaatctgagaagtgtagtatttttagcactagtagatatgaagagggatgtctcgttttcagtttaaggcattattaagaagaagactgatttccaggtttatcctgacaatttccctcttcctttcaagaagaagtgaagttcacatttttctaccatcttcatgttttctggatcatatagcttttgtgaataggttgattagttgatatcggcttctgtttctgagaaaacttcagaagcctagtatttcctcaatggcatctgttgccaccacttctcattttgtgtgagagggttgagtgagtgggtgggaccctttaagaaaataaattgagagatgagttaattatacagattatcaatatacgggtattttctaaccattcttataacaaatgactcaatccgcattcctcaatgtatgctaaaactactgagtgaaatgctattggagaaaactatatgtaatctcaaagttgcttccaaatattattgacaagttacaaaagtaaaataatacctttacatttaaataacagagaaatattgtgatcaaacaacaacaggacaaattgaccataccttcctcctctatgtagtattcttcaaaacatttgaattaatcacaaaaaagcaaccagaaaaattcaaattgaattacattctgtaaaataatggggataggctctttaaaaatgtcaatgtaataagagacaataaaaggttgggggactgttctctataaaaggaaggtatgaccacaaaaagcactgtgtgatccttgattagatcttgggtcacagaaacaggaaacaaacaaaaagaagaacccacccagctataaaggatgttattggatcgatttggaaaatttgagtatagaccatgtggtaaatagtagttttgtggcattgctgcatttcttgaattggttcattgtattgtggttgtggagatgaatgttgtggtctttctggagaagctttatttggtgtattcttaggagaattatttactgacaaagtgtcatgatgtctgctattttcactcaaatgactttctaaaaatgagtatgacagagagagaaggaaggagggaagatcggaggcagagagtaaaaacagaaagcagacatcagaatgtttatattggttctaggtcaaaggcatatgtgtattcattgtgccatcttttcaacttttgtgtaagtttgaaatttttaaaaaaatattgaggggaaatgggaattcagatgatcaagttcaaatggaatgttctatagtcctatccaaacttaattacattttatgtgttattttagaccaatcctgcccaacagtttcaaagtttatacatttgctttatttttataccagcctgttgtgaatttgcaaactgtttaaaaattgcaaagacctacataaatatatcccttagcataagggtggccatgcactttaaaattacatatgattatgtggctgtgtcaccaagattacattaatttcatattctcagaattaaaggttgatttccctatatttgacatttgcttgcaatgttactacatcatatagataaaagaaggtagaaaggtgtgaatttaggcagaggtttccctgaaaagagcttttaaaatatctacttaaagagaaacttgaactctgctttacgctctgatttacgtgtgttctaaaattaagcctttcctctgtatctgggaatcagttggggagaaaacattaaaccattttctgaaagcatggaggaagaaaagcaggcatcttattcctcttttcactccataaaatatatataaggacaggttttgcccattttaaacagacactcgcttttttttttctaatgtaacactatggtaatcttaacaaatatagaacattttagatttagctttgtttctgccggttttcctcatgtggacgccttccttctcattttgttccatctgcaccggatctaaggagagacactttccctttaagaaacaaaggttagctgtgactcctgtcatgtaaaagcctaaagaaggcttttcatagttgatggaagtgatgccaaagaataaaatgaaaagcctctgctatctacctagcgcctacacgccctggagccgacaaaagagctcagtaccagagccgaagagtccgtggagcaccacgttagtgaaaaagccgattataaataataatgaccttagtggatgctgagaactgcactaaagtttttctgagccagacagaatgatgtaggggataccatataaatgcatagaagtctataagggaagaagatgctgagagattcaatttcttcctccaataatttaaattgatggtgagttagtaggtgctcaataaatatttgttgaatgagtaaacaaaagcagtctaacaacggatttcctaatgaaagttcatgaattgaagcatgtttgcattgcatcccaactctgtattaaaactgtatctatttcaggagtaagatcagaatcctgatagaggaacatgcaaaatgttgcccatctatttagggacaatcatagagatagaaagaaaaaagatatttggaagtacatggagctcactttgcctatgagttgtgtgcatttcgaggtgggagacgggagagggagtgcaagagaggctggaatgagatttttttttgtagtgatacttggttttctgaggcataatctagtgaggagagagggccttgacgtttttatttagcgatcatgcctccagtcatgtgttctgaggctcatgttcggttttgcattgatagacttggaattataggacattcttggcttttgaactagctcattgtgctgaatgtggtaatttttgtgaaagcatactgaaacgtctaaaataacttccaaggcaaaacagtttagtacagctactgcagctatatgtagagcaccaacatttatacttagtcgggttttaatctcagcactcagttcttcggtattccaactataagaaccccatcatgcttcccttgggccagggtatcttaaacatattgaggttaacatattgagccagataattcgttgctgtggggggctgtcctgtgcttggtaggatgataacagccagtagcacccctaccccaagtggtaacaaccaaaaatcagggttttttttaaactgtctttgttggaaggaaaatcagaatcttctgaggaaaaggatttttgttctcttcttggatgttaagaaaattggcttgtgttggctgggtgcggtggctcatgactgtaatcccagcactctggtaggcccgatcactctgggaggtgatcttgtgggcagatcacaagatcaggagttcaagaccaacctggccaacatagtgaaaccccgtctctactaaaaatacaaaaaattagccaggcatagtggcaggcgcctgtaatcccagctactcgggaggctgaggcaggagaatcacttgaacccaggaggcggaggttgcagtgagccgagattgcaccactgcactccagtctgggccacagtgagagactttgtctcaaaaaaaaaaaaaaaagaaagaaagaaaaaagaaaattggctttttttttttagccattaaaataaggataagtcagttctcccccaaaaattaaatgagaagtaacactcataaaacaatttgttctctctctcttttcttctccctctccacacacacaccccctcaaattttttgctaatagtgactacaaatttctgagcagttagtggtagatgaatatcaaggcatattgcacccttttatctagctcataggtcaatttgatgtcacattgacataattatttaaatgggctattttctccacagactgttttaatttcatgaccctggtctctgggtcattgttattagaatctgattatctcatggaaaattaatatggccacatattttcttatgtgcgtccatacttttggcttacttcttgaatattttattactggctccattgcttttggttggaaaagaaggttcaatcattgctgcatagattatcattccagtaggtgccctgggcagcaatttctgaaccatcccttttgaaattttgttcccagctggagaaatgtcacagttgtctcagcttttgactctgacttttagtgagagatgcaaggaataggaaaacactttcaagaagaagcaatgagcagttgtatgcacatctggtgacttattgctgaagattctaaagcatttaaaaatattgattaagcctcaaactgttgggaaattgttcccataactttcattctgcccctagatttgctgaggttttgagctgtatttagcttggtgaatcttgtgtaatggccagaaagagacctcaggagccccatcccccaggttcttattagccttgacaagagtgttgttaaaattgcagactcttcacagttccaaagagatgccgtttcttgctgtttcaataccaagtctaaaacaatctctgtatacattttggcttctaaaatatattctgaggtaaaatagcaggttctactgtctttgagaagaccatttcttttgtttgtggtaactagtcatgttggtctcttttttccttctctttgttatatttatttggactttaatgttggctatgccctttaatgaaaaaaaatcaggcatttcccagatttagatttttattataaacacttcatattttaagtggtatatctctagggagaaatgtatgaagaattgatggaagttggaaattttttagttagtaattaacacctaccattaaaaacaagtgcaaatcacatgatggcaaagtgaatctattacatatcataatcaaagattaatcaaagtaattaccaggcaaacagggattgaatagaacttaaaaccaattaaactatttcggctgtaccactgaataaacactttggtattttaatttctcctctcttcatttgcttcagcaatatgtttgctaatatgactgaggtgcacaattgctatttaattaacctatttttgtcagaacctcacacgagctgcgtggagtagatctgctaaagtctcaataataatgagcctgataaaaaataaccaacatgaaattcgtgccagtcattttacaagttatgccaaatgtaataatatctgaagaaaaaaagaaactggttaccttacagaaattggattgaaagtacttaaaaaacatgttgaaccaacacaaaattactcaaaagtttagtaaaatttcaaaaatgtataattgccttgtttctttgtaccccactttgcatatcattaccattaactattggtaataaatctattcgagggcatggatctgttttggggatacttgagttgataatgggcacagaagggtttggtagtggacatcttttacccaatcatgtatcctttgggagagaatacttttctagctattgagtaaggcatcacgaaagtgttgatccattttgcttttattccctaagacaatcaaaacgctaacacagtttgggtggtcttggcctcaatgatacacattttttcacaaaagataacataactaaccatgtgaagaaagcctcacctttctctacctttggatagtagggatgaaagaaagtaagatggagaaatccacattaaatataaagactctttccccacaaaatcccagagctcttctgattggcaccatgaagacaaaacattctgattggatttttggttcttcacccaggtgttttactatcaggtagacacagtttgtgtacaactaaataagaccatttcctgcccaagctgtcttttttccccacacatttaaaatttactcacacttactgagcatgatgtttcaagttttctgaaacagctggttagtagccagttgatcactggcccctaaaggtaacaaagaccctccatccccaaatttttgccagtcaaaaaagcatgactttatttcactcccgtcaccccagtgctattacgaggtgtaagcacctttctagtgaaggtctattttctagatcttaggacaagaatagaatgtcacattgtaagcgttctcagaggtctgcagcaaagcccttattgtacagaaaagaaaactaagactcacaaaggtgtagatcacctgtttgtttgtttggggtttttttttgttgtttatttgtttgtttttgcagcaagatgaggattagaactcagatttctgactccctcaatgttctcccttctttatcatacaggctccttaactactggctgctttgcgtgtggtggactttaaatgatcacacgggtgccttaatcacagcctttttatgagtgacacaggcgctgagtctccctttttctaaaatggaatgttttatatccataacccagacttgcttaactaaggtcaaatttacataaacaaatgtcttccggggccagcaggtagcatgtctgggcaaaagcgtgtgtggcaaggttttgataaagcgcagaacacatgttctgtttaaaaatgttcacattcagattctcaaatctctctcttgccagaccaagcatgtccacaggctactggtttataacccctgactgcatcacgatgcagacagagtaaggaggagtgttcttacagttatgcaaatggaatccatatcaccagttccttttagaatactagatgtcccaagtgtgccatgccaaacccttttgctttgaatgccctggacttctagtattcaatgaagaggcacgacttggggaacatgaaacacccccataaacaccagctttagttcagccagtgtccccaaagactgactctgaaaagaacatacacgtgtatgtcgcataaaatccgtagaagagatgatgctgctacccacaaccttcttgggagctgctgagaatccctaacagacaaaccgaatcatagggcaaacccaccctatgtaccaaacaaccagtgtaattatattctgtagttgaggaattacataaattgcccattgggaaagaagccttaatctccatccctcccccgaaatctatcaacagctgtgtgagcctctgtgtatttttgaaaggttgaacacatttgatcggagaacaaacttgatttcctaatcaggttcgatgcgaggagagccagttagagatgtgtgtgattctcccagtgtgcgtctttgattcgtgtgctaattatgtcgatcctttggggaacacagccaggaagctgggtcctccttgatgaatgctggcggagagccatgcagcgcgcagcggagagcagttcagcatctctagtcccagctgagaatatggtcccattatctcccagctgcctaagcaatccataagggcctgttctgcgtggatgatcagtgtagtggaagcagggacttgctgagagctgaaatctctgtttgatttgctgtaacatgtaaagcgaaactgggacattttactttacagtctgtaagtaccaggttttacccccctctttctccctacagctccatgtgaatgtgactttgcaagctgcatttgattttctgttccattgctctttgttgaatcaagctggtgaggtagagtgtgatctgtttagagcttgctgtttctgttaaatctcttatataattgattcatacaaggaaataggagcctttcagaatgcttttatagaaattagaaattattggctttgtttttaatttgggagtgtggttgcattatctttggtgccaggatgattagagcatatatttatcttcttctgtacctctggccattgcaagaaaaatgtaagtaaaactaatatatatataaagagataatctttatatgcatgcctgtataaaagaagtgcctgtatttccagaatttaaatttaacatagtttattttgctgttctctgctgctactaagaaaggcagaaacagaaaagtttctcttgtttttcagttgcatgctgtttagaaactttgccatggaggtgggcaggataactgtttggaatatttgcaaatataaactgtatatctccttttttatgagacagtacataaaataagagtctgtgtttagccccttattgcttttgaatgcaccacttcttaagaagtaatgtgaattaaaaaaacaaaaaaaatcactttaaatttggttcatttatctttttatgtatcctcaaatgccatctatcaaattaatatttattattcatgcaagattcattgtaaaaatgctattagaatttaatattgttaataatgtttgcatgatgtctttcacatgatcaatgccttagtgaaattaaagattgttatcactgtggaaagggatttgtggatttttctgtttccctaacctaaacataaatcacacctgtctttttttattaaaagtggaataattgagctgttgtaaaaattgaatttgaataaaagtggcttgaacagcatgaaccaatggccagggctaatgtgaaccaaagtgaacttaaaatcatgaatacctgaaaaggggaattgaagtttccacactgagcttgagaccatggagcctgatggtcccataatttccagagtgggaaatacagtttccctgagtaggcagtaagtctcaaggcagagaaaaaccacagactgtgaagtacagaagcatcttactggtgaggacagagtatgttctcattagatttggtggagaggaactgtgcaagagagagaagactcaaaatagatggttgtctacatgagcacaggcattttcagagcttgagatttggagggaaaatgatcacaaaacagtacagaatgcttaacatctggtaagatgaagcaaaagacggactctggtacctctgagtagcaaacagtcccagggctgtccttgccaagtaatcagttctctggaaaaaagtaagtgtgcaaaaaggcctgctaatgaaatctgaagtaacggcaagtggttttgatggctatatggtccctaaacaaaaggctggcctcatgccttcttacaaaactgaactgacctttgtgagtgatgattcctggtgaacccttagctatatttttaaataactgttagtgtttttctgactactgcaagtatatgatcttgtgcaagatgtgatcttgttttaagagggatttatggatttttctgttcagaaataggattagttaaggtccagtgattttttttaaacaaatgcttaatttgtatctacttggttgagtaaatagtgttcttttgagtttcgatttctttttttttcagggtcccgaacccctttatttgtacttagcagaaacgattgccttctgtagaggagtatcttcccaatgtagttaaatttgatttttattttccattcaaatatttagaaatttcaacttataccttacaatattaaacatttttgtagtcagtcaccacaaatctcagagaggtatttgcaagatttgtagtttgcttctattactttcggaatgtttagataattttataaaattgggacactgtcttcctagttgtttgcttaatctgcaggaaagtggattgaactctccaggggtcagtttagggtatgtggtctcttgacagatcgggaagccagatataccttgtaagaggtacttctaaagccataacaatttggtcttcaaaataaatttaaagtgctatgaaagagaataaaggaaaagtcttgaattgtatatgtaaagatagtgcatctctgtacgtgtttgcatgcatacaaatctacccaacaacattgtggacaatttctgtgctacccaagtacactagctctttagttcctagaaagccctggggttgagccaagtggaaagaattttgtaaattgggatacagcagcagagagttaaatctccttgcattctttgttttggaccctcggcagactgttttgtttgaccccagagctgccggcttaagcacaaagaggactttataacgtcctcagcggcatttggaagcaggacctctgcacacaaatcataccctaaccctccttaacagcttagggcagccactgtgaagcaaggaatgcagttctgtgaactgtctctatgatgacaagttaaagagtgaatatgagctgggtgtggtggcacaggcctgtagtcccagctaccagggaggctgaggtgggaggataggtcgagcctaggagtttgaggccagcctgggtaacttagtgaaactctgtctttaaaaaaaaaaaaatgaatatgactgaatgaaaaataattaatttagtaactgtaatacttttggatgattttaaatgttatcaagccttaactgtgcattgtcaaagtatacactccattggttatctctagtaacagtgaaagattgagttaacctcctgtaagatgctgtgcaactctaacaagctgctttacctctctgtgcctcaatagcccccagtaaaatgaagtatgatttctgtgatccttccgaggttaagaaagttacgaactcatgacatcttattctaactgggcattcatgcctggaacggccttcaaattgcctagggacagggtgacatgtgacttagctgtcattttaaacaatatttcactaggatgctttcattttttcttctttcatttctctttctttcttcctccctttttcttccttcccttccctccatcttctgctaccccctccctctctctctttctacccttctccttctccctgtctgtcccgttccctgttctcctctccctctgcctccctctctctctttttcatcagttaattgtcctcaagtcaagtgtgactttagaaacgaggttcggattgtctgctcatttgcataacctgtttgcggctttctcttatgatagttcattgaagtatcaatgacttactgatatactgctctgttatatattagaattacttagctttaggcatgtatgtgcagcagggacccagaaagttatgctgcatatgtaagtgtgtatagattgcccatgttaatttttaaaataagagtgttgttaatcttatactctaaattgaagatgattaaggtgaaggatttatcttaatgtattaagctaacaatatttactttaaaaataaaacaagtgcacaaacaatagcccatttcaaggtagcaggatattaaagagcttgatttttaaaaagagaaaatatgttcatcgaatgatttgatttttctgtaagaaattgtcttgccaaacagtatggaaaaataaaaggcatacatcattttattaacaaatagatacccgtccacataatgaagtaagcaactttgtgaaacatgagataggaaaaatattttatggaaagtttttttaatgatacacttcttgtaatcttaggattgcttatcactagataagtcctcttagttgaaaacagcagatgaagaagttactaaatccatcactaatgagtgcttcttgatatactcgaaccaacttgtgaatacacttcatttgagaatctttactgcagatactggaaaaagctaaattaatttcataatttatacttgtaggacatggattgtagtgctttttgtttcttccactgttaaatggaatagatggaatggcacaaaaatttacggactaatattttactgtacagttgactatatatatatacacacacacttataaatattttttaacatcaagtgtactccaagatggatgataagtggccatttgatgacagtaatagcttggatgggctcatcttatttcagatcagggtagtgttatgacagcttttaaatgttagttgaaatactcatttttctctccatttttattattgggaggtctctatatgtgtcttactattctggagtttgaatattaatgttattccttattgaacttgtaggctatatttgatgcatatatatatatatttttgatgcagagtataaaattaattttccaaatctcataaaactgagtagatatcctggctttttaggcagcaggcctgttgtaagtagaatccgtaatgtgaaataatttgttttatcgtcgtgcatccatctatgaccaaaatgattttgtacttaggaactatttcaatgcaaactagattatactgacagataatgtttgataatttgtggctctcaaatccttgattataaagttaccaagcagcttcagggacattgcttttggttttaatctagtacctctgttgacttgagatgttcaattcaatattacttagttaatagctccaatggcttatccgactgttttattgtatagttaaaaaggtaaagtaaattggacatagacatgactctagggcttgtacatggcttcatgtcttcacctctattccaaagtaagaagggaagtccttctgcatttttgcatgaaatttctctatgttttaagggaggaatggggtgatttaaaattgagaggaacacatcagaaggagctgcaaaggaataaagtgtttcttatggttagatataaaatgcagggctatacattctgaagatatggcagaatttagagaagctgactatgccaggcatttggcacaggggactaaaggagacagatttaatgcttgccagaaggaaaccctatatcagtggatagaaatttgagtgccctgcaagcaagcaataacaaaagaaagaaagaaaaaaaaatgtaaataaggaagtagaggaatgactgtattgtggttggaagagatgtggtttcattctgcaaaggaaaattgtgagtgaatgaaatatatcaagtgtaaggacattgggactaattcaaaaatattttgcataggtattgctaagttactgtgaaataattaagacatttggatcagtgaagagatacagagaaaaaggagtgctgttggatttgactgtactggctgacacactttaacaatgtaattatcttaaatgaagtgggtattgtgacaccgtagtcagtctgtcttatttcagtgagtgtttctggagtagttaatggggatattccatctagttcagtagatattgataaatatgtatttatggaaactatatagcagtttttacaggctgccagtaaattaccttgatccttctaccaatgtctgtgtttctgatcccccactcctccctccaatgatctgtattaccccaaatagtcctaggagatggtgtgagaagactgagtttgaggaggttgattttattaaatcacttcaacctttcagagagtaaataagttcttacggtagggcgtaatgccatgcaatactgaatgacttcttgaaatcctttcacttcacttttcctttaccaagcactttgtccagagtaatatgtttaggtcttccaagcatttagataaataaccttgtctgctggacatggactcaatgagtcataccactaattaaacacggtcatttgcaagaactttgcctcctcgctggttagaattcattgtatatgtgtgtgcctttcagataggtaaagctgctcacacacaggcataatgcttgactccaggggtgaaaacaaccaccatctctcagaagagaacaaatcatgtgttcaaacatggtctctggcatctttttgatgtgtgtgttaagtgtgaatctggtaatttaaggtgtgtgactcctactcccatccagctgtctggctttgtgcttagagagaagaatagcaacagatttagactgacacaatccttccctagagtccccctcccctacctctccctgcaggaatccacaagggtattcggttgattgctgttgttaacctctcttgtagtattatatttcttgttgaaagtaccttttgtggcatgtgagtacatttaagagatgtgaaaggctttaaaaatggctttacttttaaactttcttacctaaattattaggaggaaaacagtttcttaggttaatatgtgtgtgtgtgtgtgtgtgcacacacgcacatgcacgcatctaggctaagatctttgcaaacctttaatgttcatcaagggctgtgtctaaatgatacgttgattataataggattttttttccaaatcattttcgtaatacatgaataatactcagaatgttcatgtaaagtgatagactgaactatttcacttgagaaacattcttgatgttgtacatgacagtcttcggtcgcaaaataatctagaaaattaggaacatgtctgcaagtctggttaaggctctgacagttcttctaatatatctgttttggtgaactttgagcatcacagagttttctcaaggtatgaaataaatacctctggtagaatgtttgataatctcagagtactcaggaatttttaatagatatgttaaagataaaaaatatataactagtaaataaaacatatagttttacagatagaattgtttagcccatggctaaatggataaacctaaaagttttgataagcaattttggaagcgattcttgaatgtagcagaacttgtgatgatgatgtggaagtatagggaaggtagaactttgcctgtgggcctgagacttaaatctacacaaaacagactaatagaagaaaatcatacagatttttcacatttacatgggagccgccacaggaaaatgaagacccaaagaagtggcaaaacctaagtgcttctatattaggttgaacaaagagaggcaattgtaggaaaataactaaaatatatggggcaactaaagaaaaatatgagttattttaacaagatctgtttgtacagaatacccttggttttgactccctgtctctagtgataagaatgtttcttttctcctggtttagggaagacatctttcacataggagttttatctcctgatgtgacaatgaaaagggaagatcggcttgccctccttgtaccaactgtgtttcaagtgtctttagctcaaaataatccttttgccaaagtggcatattctgataagggctcttctgccatccctcacaagtgaccttgccataagttatttcttgtgtgtctaaggatgacaccctagccaacaaggaaaatggtgacattcaattatggaattttaggcctggacatgatctacagattgtcttgtctgttcctctaccagtaggtccagaggcttatccaagacagaatggtcttcttgtagtctgtctagggatagaatctagaatttccagagccccatatgggttcccttctctggcaagaaagtcattcttgcatttcttttcacattctgtaccacgaagctagaactctattggcagccagataacccagaaccaaagacctgcagaaaccaggctgaacacacgaagtgtgaggtggaccagttgtcaggcaatagggagtccacagggtctgtaaagaacggtgcatcagggttcctcctaagtgttgtggccatgttggattgtggggccagtgttgctgtatctcaaaaattttaaatattgctgtttatttttaaaatgtgtgaaagctaaacgcatctatcgaattcataacatccagttttcaacttctatggtaagttatttgaggcatctctcattggttgcgggaaaaatatgcggattcacatcatgaagtggcatatactctacctaagagagggaacctgtgttaatgatccatcttgggtacttctagggaggaacctaagagaatgaggtaaagcatgtaaggattcctacaaggctttttttaaaccctaatatgtttcattcattgtcagtttataaggatcagatttaagaaatcatattacaggtatgagtctgaagttaatgacacagaattcaataaatatattttgctatgcctaagtaattcaggtcaatagactatattgtagttactgattttactaacatatttaatatttttatttctactggggtgctaaagttgccagtcatgatttacattaccatagaaaaagataggttggtgattgcttcctttttttttttttttttttttttttttttttgagattgagtttcactctgtagcccaggctggagtgcagtggcacaatcttggttcactgcaacattcaccatctgggctcaagtgattcttgtgcctcagcctcctgggtagctgggattataagcacctgctaccacacgctgctaattgttgtatttttagtagagacgggggtttcacaatgttggccaggctggtctcgaactcctgacctctggtgatccacctacctctgcctcccaaaatgctaagattacaggcatgagtcaccacatccagcccttttttccttttttaaaaaaacttttgatactcactgattaattgggcaaatagaggaaatctgcaaatgagagggatagaaaaatggtctaatttacacttttttttaaaccacaagatagagcctaaattccatttaattttccactagacattttagacattctatctgataaaggaacagagaacacagtgctgggctgtttaagcacagtcatttttcttgcgtacctgtgcagatgacagaatcaccaggtggtcccatcttgaggaccactggcctatatttattaattcatttaacttattattaattaaattcctgccatttacctcatactgtttgttctagagttcagagatagaaaatgaacaatatgaacaaacaaacaaaattactacccttacgaaagtacgtgcattctagtatggtgacaaaaaggaaaggcagtgttctccaagccaccctttggatctgaggcgccttgtccctattttcactacttcttcttgctctgttggctgttttgcccagctgaacatacttctgtggtatttaagttgatctcatataggccatatgaagtggatgaacaaaagtttttcagatatttttgtgaactcaaaattatgtgggcctagaatagctgagtaattgaggcaaactcttatttgtttgaagataggattttgtaatcaggccatccagctactgaagcaggcctctgcttcattttgtttctgtgaacaagggtggacctctacccatcccccccaccccccgcaataagtcactcatttctcaggtgtttttgtttctgcctgccttaaatggtggagttgaccaaattgactattttgaaacctatttataacttctagataagggtacagccatccctccctaggacatggttttaagtagagttgaatgaatatgtgaggaaggaagcattttgagcttttttgaacaagttttacaactgcaaagtgctattactattaaagataataatttagaagtaaatattatagcaactaagtgcaaaagagctcttagtgcactattttcatttcaccgtataaaaagaaaattggtagtaaaatatatagtgtttatctactttgtaatttctttcccccaagtctattgacttttctctcccttcggacttccctttggtaactcagaagcttacctaagttttgaagtagccagctagaaggagttacagagtagatgacagctttgtctttttttctactatcagagggctcaacactgtggagtgatttgtgggggcatctgacatcatcagaggcgcaaaagtaatcgtgcttatcactaaagagagttggctctaagctttggtaaagtggtcctgatcccgtgtgatcctaaaaaaagatgagaggaatgatcattactgtttggagcctacaggctcaataaccttctaactctgctttttaattaaacacagagcacttaggggtttatttatccattatcaggcaggcaaatcctctactgacatcattagattttatggcatgtggcctgcctaagcagtttgtgtgtgtgtgtgtgtgtgtgtgtgtgtgtgtgtgtgtgtgaataattaatatgaaagatattacattactaccagtacaatatgctttacttccatagtctagaaacatgcctttttatgcaaagttgcaacatgattcaaattgatgtagtattttaaagttaaagctctatactcagtattaacaaggtggttgcattttccacagagactctaacaaacgatgtagtcttaaatatcaattgatttacaatatctcttagcctgacatcaatattaaggctttaggatagctctcacatgagaaatctgatattttgaactttggatcataattaatttcacaatacagtattgttatcttgtattacatattttttctcatgttaatttgacttactggctattaataataagaaacgcactatttcaatgaccgaagagtgcaaacattaggtagtgatgctagtagaaaaacagtttggacagtgcttcttaaacattagtgtgtggaaatgcagattctgattcagttagactgactgggactcaagactctgaatttttaattagctcccatatgatgtcagtcttggtggtccacagataacacttgagtaataaggataaagaccatgtggaattccctgttcagcccacatgagatttcccaactgaggaattctttcttgagtgtctttttctttcatctttgtctcactgtattgttatttgaaatcagaaaataaaaagtactagattgatagctctgtccacctgtcaagtgaaaagtttgcatctcattttgtattacactattttatgccctaaatctttgctttctgtcctaaattgatctggtacatctttgcctgacatctgagtcttgtagatagttatttaaagatatgtgaagtaaaagattgtgaatgtcatggctagaatagatgctatctccagagtctaggaattgaggtatgtactggagacaaaacagacctgttctatatggaatgttctggagtattatgaaagacactcttgtttgtttctttatttttcaccctgtggcttatgaaagtgaaatgtgggcttttctaatatatgcattctctagtttcctatacactgttgatttccccttagtaacattgcatattatgttgctcctagtggtgacaaatctcaggaaagcaagagaccttaaaaaaaaaaaaaaaacaaaacttttttctatttgtgacatgatgacagctgtcatgggaatggggaaagatagaacagtttttcagaatccatcaagtgaaggtacattcaatgctgtaacttaatgaaagttgctttattgtgacatgagtcagagtctttggtgatgcaagtgtggaaggatcttttctgaaagatttatgcctcaagtctggatttgagctgaagggacatgaccttggctttgaacttgaaaaaggttaccctctgtaagaaagtccagagtcagtatgaagaggttttcagatcaggacggcaacagagagtaaacaacactgcagagtctctctgaaatgtgcaaatatcatgacaaggagaggtctccttagctttatttacccagaatcctcacgtaagaggtagtcatctgggtgcttagaaatcaaaatgaatgactcactttttcaattttcatcaaaataacccttgttttgtaaatatacacaaaaaaactacccatcatttgaaatttctattgtaaaccccattgtgaatgtattattgaaaagattggaaaaccttaagggaaattctcaaccaaatctttttctgaacagcttttttgagtggaataattatggtataattcttatgtcatacaactaacacatttaaattgtacaattcagtgtttttagtgtattcacagaattgtataaccatcagcattatcaattttagaatatatttgtcatcccaaaatgaaaccccacctgttcacagtcgcttcccatttctcctcaatccctccctagaccaacaataatctctttctctgtgcctcgtctggatgttttatataaatggaatcatacaatatgtggtctcttgtgactggcttatcttgcttggcatcctattttcaaagtttagccatattgtcgtgtgcatcagtacttcattcctttttatggccaaataatatttcatcattttagatatactacattttatttatccattctttagttgatggacatttaggttgtctaaatattttgactgttgtgaacagtgaccctatgaataatctggaatcgtttttgtgtggacatacacctaggagtggaattgatgagtcagaaccgaagattttaaccaatatgtttaaattttagcaacactgaaatacagtggatgtaactaaagagaatatggaaatggctataaacgaaaatgcttctcaatgaagagttttactcatttgaacaaaggaactatccctcttatttttttagtctctataaagtaaatgttcccaacactttttgtccatctcctctgtcttcagtagtggcacactgtccatgaattaaggatatgaatactaggcaggaagttaaattctgttctgcaaaaaaagagtatgtcatttctgcttattaagaccatgataaatgcaacttgaataagaagaataattgtttagttaacacaataggaaaaaaaagtttaatagaataccagctcagccttttggaggcttagcatatttgaatggcaacatagaacactgtagggaaactctcaacctgtctctaaaatccagagtttgaagatgcagtaaggttttgagcttgtattttctcatccctgaaagtgccaattaagataataaaatttagagcctatccaagttggaattagatcttcactgtgtgtgtcactgaatatgacgacctggatgagaacacctattagaggggaggctcatttaatgcactggagatagctatggtgttcatgcagcatgcactgtggaaggctgtttggattgcatttgattaccactgctgtgtgtttgatgttttgcaagtattctatggggactgccttttctttttccaattgaaaataggctagaaaagggatataaacatgttagtgctctgagaaaaaataaagatattaatatatttctgcaaaaattgtctttcttgacctgaatcataaaaggtattgtgaacataacaactgactggatattgtttatattgtcggtaaatttcagtcagttgaaaatattttaaagtccatatatatctgtgaaaggcatagatgtaagctgcatttaatgtgctccaaaatcaaacaagcaagtattttacttaaaatgtaggttattggcatacctttgtgtgtatgttacttcaatgttgaacacaaggtgtaaaaatacagtattttacatttctgcagaatcttgtcactacagttttctttcatttgaacttaacagatgccaagattttccatttagtaagtattattactagcaaatatattatctggaacacaatcagtatcaaattctggctttctaagaatattgaaaatgtatatgtagaggtgaatattgcagataaactgagtactgaaggaaatggttgattaaatattattcagtttgctttgtagtatgatgaaacattttatatatacatatgtgctagcacacacatgcacaaacacatgcttacattgtcacagggaaacaaatacacattatacctccacccccattgctactacaaataaaggtcttaacaaggtaggtttcttatcacacatcttacagtacatcagttaagactgaatcagggacagcacaagacaaaacagaatcaaaaaggtagtgtgactgcagtatatactgtacatttagtgagtttctatttataatcccgcccaccctcctaacacattttacccatccctggcactatggtcctccctatgactcagctcccaggcccttcatgcgccccacaatcttttttctctccaccttctcatttctctgtctagatttattcttagtaaaaactgagaatactctgtttcagaagttgttagaattatcaaagttaaaagaaggaaaagaagctggtatttctgcagtgtatcaggtagtttcacctacattttatggcatatttaaaggacaaattcttccctatgactaaaattctcctgcttggaaaacaaataccaaaatcatagccattcctagtatctgtaattgctaaaaatcaaagttgtcaaagttgaagtttatgaatgaaggaaatatagttgtataaaagcaaaaaatgtgaaaacttacatagtaactaggataaaataatccaagaataaatttattccagtctaagaaaaaacttgatttaccaaaatacgtatgggatttagggtaactattacatgtaaaccaatcatgtacttttttgaaatggtgactgttgcacactttacattctttctcttatattcatgaaatataccactaatattttgatataaaaatatcttccctgaggtttttttacttaatatttgcataaataggcatacatccatgcttgggaggcaggttgagaaagaagattatattttactgaaaaaaattgtgggaatcatagtcttacaagtttactggagctgctaacagagcagcatatgtgcaatgagaaccatccttgataactggtttgcttagccactgcccaaatctctagatctgaatcttgttttcattgctgactttctttatgaactcagacacataccattaacctctctggactttggatactttctcagaaaacgtagaagacagattgattcttcttaagccttgttcctgtcctggcattccttaagaatgaggttgcatccagctgcagtgtgggtgcacttgggcttagtgctttttctgagacactgtgttgagcagagatcttagccatgcactgttggtgtgaactctggattccttctggtcattacatgtcctctggcactgttttccagctgagggctgtgacctcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcggtgtaaaaggtcaaagccttgcttcatccgtaaagcaccttctttacataatagcgagcattgactctgggcatagcttatgtcccatcccctcttttcctgaggattactttaaatagaaatacctgtctattatttaaatataattttgtcctctttgtgtcttctgagagctagttgcccctagatgtctttcagccttgctcttcaacaaaaatagaacaagtttattggtagcccttatgacacatcccccacagttggatacttgatcctcccccttttaaatctgccctcaattctttctaaagccatctctttctaaagcaagagttctgctttccttttgttttcagatatatgtcccttcccgatgtctcccttcatttctaggtttcagttttcaatgttctttcatttggtcatagactttttctgtgttctttctaaaacaatcagtgtactttcaagttgtcacttttcattctcagctatggggtgaggtaagtaggtgttcagatttttattgatgtcaaggcctcctcttgtcgctgaattggttgcatcttgttcacagtactgagtaattattaatatatcaaatccaagctcatatgttgattggactgcctcctttccccatggatgttgtagtcttgattctttgttgtatttcagaaaggaaacctctaaaattttattattttacatttgaaattgttatttctattttattggaattggattttgattgtgtattatctcatatgtggagaaatcaggaatatcaaccatgttatgctacactgatgatcagtcaatgcattggcccataaaatgaacacagttatacaccagagatcaaatcattcccattaaaacaactagatgctaaaatagcactgatattaggaaaaccatgctatgacattaaaataattcaatccaaggtgaaaccgaaactgatttgtctgagattgtactactttactgacccattttattaaacgtaattttttaaaagcacttttaggaggtagatagtatagtgcattattgagattataggtggtggctaaagccctgtaagtatattactgaaacaaattttttcaattctctggtagaatatgaaccaaggtttttttcaatattagcctttaaaaaactcttaatactccataattagcctacaatataataatttgtttccacctttagtatgacaagctatttcttgatttttttcactgagacataattatatatatttatgaagtacatagtattgtctcaatgcatccaatatatagtgattaagttaggttaatgagcatatcctgtcacctcaacattcatcatttctttgtgttgagaacattcaaaatcctctcttctagctttctgaaaatatataataaattattgttagctatggtactcgtacagtgctatggaacagtacaactgatttatcctatctgcctagaattttgtatcctttaatgaatttctccctatctttgctctccccactcttcccagcctctaaaagccactactctactctctacttctaggagatcaacttttcttagcttctacacaggagtgagaagatgaaatatttatcattctgtgcctggcttatttgacttaacataaagtcctctggagtcatccatgttgccccacgtgagaggatattactattttttatggctgaatagtattccattatgtatatatacgtattttcttcatccattcatctgttgatggatacttacattgattccataccttggctattgtgaatattgctgcaacaaatatggtagtgcagacatctctttataatactgatttactttccttcagatatatacccagtcatggtattgctagataatgtttattgactttcatatttgtatggagtagaaaatgtataatatgtattatgatttgtaatacatgtattacttactatatacaaacaacagagccaataaaatgacatagcctatctgtcaagaaatcaacatgagaggagacattgttggtttcaagggatatgccttttttcacaggtaggttgatctttgcataggctaaactattcacactctgtttagctgccttgatcgtctttactcttgtttgagtaacttggtaatggtgaccaccatatgatgaggaggaggaggaggaggagaaggaagaggaggattatattattgaccaagatgatgacatcactgacaatagataataccagaatatcttgaaatcctaatcctttaacagctgctggtttgattccagttaggcttctattttcttggccctagtgcagtagatgagctccttgcacttgatatattttcatcaatgaaaataaaaaagtgaaaatgctgtgctttttagatttccctcatgtgatgcttgggctatatcatcacacttcctccctggcagtggaatcattaccttctgctgttactagtatagattttcagaaatcttgtaataaatccactgatttgagagcagtaggagcttttctttctaggttgcctctccaacattttcatcttgatatgcattacttagaattcagccaaaataaataaaatccagctctgtcactgcttgacaaatataatacattgtcagtgtacctgtttatttcactaatatactctattttcttcttctttctcctcttcttttttttttttttttttgtgactgagtctcactctgtcaccaggctggagtgcagtggcacgatctcagctcactgcaacctccacctcctgggttcaagcgattctcgtgccttaggctcccggatagctgggattacagatgcgcgccaccatgcccagctaatttttgtatttttagtagagacaggggtttcaccatgttggccaggatggtccccatctcctgacctcgtgatctgcctgcctcagcctcccaaagtgctgggattacaagcgtaagccaccgcacctggcctctattttcttcttaaaaccacgttgattgggactatggcctctaattttctcataatttagctgttgtatgttagcattgtcttttaggtgctatttgcattttccttttattatttagagaacacttatgtagccagatttttttaccttgagaaaatgttcttaaaagtgtaactcccgtgatctaagaaatgtcattcagccaagaagttactctaagctttattgtctgaaataatttggaaataattctctttaaatttcaggaaaaagaggacataaaccactgttatagtttcagttgtttttaactatgtgttgaagctttcccagtctcttaccttgtttattcagttgtgttaatttggcagttaaaagaattgtgccatcttcatagatgactcatgtggaagtatactatctctactaacagaagtgactacagacatccaaaaatgaatgctaagcctggggaaagaacctcctaaaaaagagtcaatatgtttgatgacattaaactgcacactatcatttgtgagtattttcacttgtcaactggaaaacaacggcaggtcttgagatctacctcatcctcctctgttagccaggaaaggagacaaggtgttgtcttcagggtgttttcccttcatcatgggccacttggagccaaaaacatcaagggaaaggaaggagcttgggcgggtaggcctgggtacgggagatacatttttgcttagttttcctcagggatagtcaggactctataattagcagtctagtcaaagagaagtttggaggaacaaatgagggaccttctccatctccattgtctctctatgccttcaaccagggaggcagtgagtctttagggatccaagctgttacccctagcttgttaacatttaataactacatgacctaaataatgttgttctcttttcacaattctcagttgcaaatgggagagtagtataatgattgccattggatgtccatttactctttcagccattgaccgcccttattccattaaacagaaagtagtgactctttcctgactctcttaacgagatttctgaccttttcccctgctttatattgtctttagaagtaaagattccatttgatgagtggaattatctcccccatattaatggtgatgaatgctcttgagaggctaatgcatgcaatttaacaaattcaaactcgagtcaaaatctgtcttaatattcataataagaacttatgtgatgtccctgacatccagcagaaataacctgtggcagtgttcgctctaatacttgatcttgtaagagaaaatttcaaccttatacacattttagaattacaactgagccagcattacagtgctaaagaatgagaaactgttgtgttgcctgtttttgaaatgtaacaaaagccatgttttgagagtaattgacttcttaactcacactggacttttcatgtcttgagttccctcaacctgtattcttgtggctgattttgctaaatatatgtacttataaatctcctgcttattggaagattatacatttcaagttcaaagatgtaaaatagactagtatttctctattttgtgagatagtttttcctaggtcttatggcaggatttggggttttgttttttgtttttttgagagacagcatctcaccctgtcaccctgggctggactgcagtggtgcaatcatggctaactacagccttaatctccctgggctcaggtggacctcctccctcagcctcctaagtagctgggaccacaggcatgcaccaccacatccatctaacttatgacaggttaaagggagaattctttcttttgaccaaaatgtttgtactaggaacaaaaaataaaaatagtagccatccctagactctgtatttttgaaaatcaaaattgtaagtagaagttgactaacgaaggaaatatagttctatgaaagcaaccactttttaaacttcctgctttgcacatagttaactggaagaaaaggaaaccaaaaacaaatatattctactctcaaaaagcttaatttaccaattattagtgaaaactattgtaaatattcatttaaaaacaagagttgtttacattcttaaaaaagtaactatagcagtcttcatactctttcgtgtcatacagtaataagattatattttgatagaaaaaagtcatatcttccctgaagtttttttatttaatatttacataaatagacatatatccatgcttgggaggcagggtgggaaaagagattatattttactgaaaaacactgtagaactcatagccttacgagtttactggggctgctaacagagcagcataagaaatgagaaccatccttgatcattggtttgcttagtcaccgcccaaatctctagatgtgaatcttgttttcattattgactttctttatgaattcagacatgtgacattaacctctctggactttggctactttctcggaaaatgtagaagacagattgattcttcttttttttttttttaattatactttaagttctagggtacatgtgcacaacaggcaggtttgtttcatatgtatacatgtgccatgttggtgtgctgcacccattaactcatcatttagcattaggtatatctcctaatgctttccctccccctccctccaccccacaacaggccctggtgtgtgatgttccttttcccgtgtccaagtgttctcattattcaattccgacctatgagtgagaacatgcagtgtttgattttttgtccttgcgatagtttgctgagaatgatggtttccagcatcatccatgtccctacaaaggacatgaactcatccttttttatggctgcatagtattccatagggtgtatatgtaccacattttcttaatccagtctatcattgatggacatttgggttggttccaagtctttgctattgtgaatagtgccacaataaacatatgtgtgcatgtatctttatagcagcatgatttataatcctttgggtatatacccagtaatgggatggctgggtcaaatggtatttctagttctagatccttgaggaatcaccacaatgtcttccacaatggttgaactagctgttcctatttctccacatcctctccagcacctgttgtttcctgactctttaatgattgccattctaactggtgtgagatggtgtctcattgtggttttgatttgcatttctttgatgaccagtgatgatgagcattttttcatgtgtctgttggctgcacaaatgtcttcttttgagaagtgtctgttcatatcctttgcccactttttgatggtttttttttttcttgtaaatttgtttgagttctttgtagattctggatattagccctttgtcagatgagtagattgcaaaaattttctcccatgctgtaggttgcctgttcactctgatggttgtttcttttgttgtgcagaagctctttagtttaattagatcccatttgccaattttggcttttgttgccattgcttttggtgttttaaacatgaagtccttgcccatgcctatgtcctgaatggtattgcctaggttttcttctagggtttttatggttttaggtctaacatgtaagtcttcaatccatcttgaattaatttttgtataagttgtaaggaagggatccagtttcagctttctacatatggctagccagttttcccagcaccatttattaaatagggaatcctttccccatttcttgtttttgtcaggtttgtcaaagatgtgtggtattatttctgagggctctgttctattccattagtctatatctttcttaagccttgttcctgtcctggcattccttaagaatggaggttgcatccagctgcagtgtgggtgcacttgggcttagtgctttttctgagacactgtgttgagcggagatcttagccatgtactgttggtgtgaactctggattccttctggtcattacgtgtcctctggcactgttttccagctgagggctgtgacttcagagccttggccctgtttcatctttttatgtggatgtcctctgaagttttaattgcttacactgtcttcctttttgctccctgttctgtcaccttagaagtggtcgttaaaagctgccattttactcttgaggactggcacaccaaatgagggaacaatgtatgctgctgctgctgctgttgctgttattgttgctgcggttgttgtggttgtgtgagtttaggtggctgtggagaaacgtctttcaagatttagcatctgaaacgagaagtgtgttgaggagatgggattttcatatcgcctgttctatctttgcatgcagtgtaaaaggtcaaagccttgcttcagctctaaaggaccttctttacataatagcaagaattgactctgggcatagcttatgtcccattcccacttttcttgaggattactttaaataggaatacctgtctattatttaaaggtaattttgtcctctttgcgtcttctgagagctagttgcccgtaagatgcctttcaaccttgtacttcaacaaaaatagagcaagtttattggtagtctttatgacacatcccccatggttggatacttgatcctcccccttttaaatctgtcctcaattctttctaaagctatgactttctgatgcaagagttctgctttccctttgtttccaaatatgtatctcttactgatatctgtcttcacttctaagtttcagttttcaattctctttcatttgatcataggcttcttctgtgttttttctaatactatcagtgtactttcaaattttcacttttctccttcaaccatcatgtgaggtaggtagctgttgagattttcattgacgtcaaggccctccacttgcctctttagagacttgcttgctttttgttcacagtacttggtaattatatcacatcccagttcatatgctgcttggactagccctttcatgatagagattcctatgttctaatctattcctaagtgctaagaggacccctgtttctttatgttaaaccttaaaaagcatctctgttggatttggtagttgtatattttgatgttatttctactattatgtttttgaacattttaacaagaagagaaaacctttttttgtccatgcatgtttaagagaccccctcaaaatagactgagtcaaaaatatccctttcagtagtacactttcaaaatgtttgagatgtctctgtgaaagggctaatctggaagtctttgacagtttggaagcctgaagaaatcccccattttcccaaagctgtgtttttgaagactgttcttcaaagagcaagcccaccgttttgctattagtgccaagaaagaacaatgagtagattttctgtgtcacaaagaaaagtagtagacggaagatctgattgccaccatgttgcatttaaaacctcattttctttagagaactgtccacaggactctccaataggcagggatttaagggtgaaacagttcagaaccacatctcccaccatataactcaaagatgacgtttatatatctgggaaccttttaaaaaccatctagatctatgggtaaatttcaaatccacaaagttcaactggatggaaagtttactcaaatgcattctttcgtcccagtttttaagcctaatcctactgcttttaggctgactgaaatttatagaactgaaatcatcattgtatctccccagtgactggtggtgatatttgacttcatatactgagaccaatttttatttaattcacatttttggaagagcttgacctgaaagtcattgccctatgctgaaaagattgaattggttttctcaagtatatatcataaaaacagttgatcctatcgaggtgaggtcatatcaaagtagtacactgaaattgagccctgaagaaaatattttttaaataattttttttttttttttggtagagactggatcttactttatttcctaggctggtcttgaactcctggcttcaagtcatcctcctgctttggcctcccaaaatggtgggattacaggcatgagccacaagccacccctaaaaaatgaatatatttttcagatatcaaggcctagcaattttcctaggtcagcaaatatagtctcttctttctgtacttcacaatgcaacatttgatattgagtagatgttgtagaacattacgttgaagagcccaggttctagaataccaccatatagtttagatcttggctttggtgctcgatcattgtgactttgagaatattgcttaaaattttctttcctcagcttgtctcatttataaaataatataaaagccactctctaccatgtagtgtttttgtgcctaatatatgagtagtatggaattgaatcttaacccactagcatctgtagtatgtgctactgcagtatacgaaaagatgcagtagatttctaaattttggggggaatattgtgttttatgcacatgcgttctataagggaaatttaggaaaccatgtagtgcatgttttcatacactatatttgtactggtatgaagtcacacagacagttggaatactgtcccgaagatatataattgtttgagtcacagaggttcctacgactccattaagacagaaggtatagcctagagttggtgggtctgagacagtgtctccaaagtctgaaggataataactgaatatagactccaaaatttaaggcttcagcatcctcagagtccttgcatttgtgagagctatgtctgtgatgttgccgtttgtcaccaggatactttatgttgtcttttaagtgttaggtgtccagatgcagatcacctgcatcttgcctcatatgtctctctgaatgtaaagattttgcctacatctgatgaaaactgtccactgttcacattatttgtcatatgtatctgcttggagcagagtaagacacttctaagggaacttgacatttcatgacccaggatatcagattcatccttaccactagctactctctgaaatttgggaatttcgttggtcttatggaccacgatcatgagactttttagaaagatgaactaaaaaatcgctattcatgcatccatttattcattcatccacatatccacccatcataaacatttacttcagttacttatccttctgcagaagggagcaagctgaaaacaaagtaattgggggtacatctccaataaccctccttctggaagtggaatgaaactccctccttcccgtcaagtctctttacataagtaaattgtatagaatgaattgtgctcctccccctacccccaaaattcatctgttttgaaggcataacccccctgtacacctgattgtgaccttatttgtaaataaggatattgcagatgtaattacttaaggtgatatcatatagaagtatggtggatccctaatgtcatatgactggtgtccttataaaagggggaaatttggacacaaatagacacacagggaaaacaccatgtgaagactggagttattctgcacaagccaggaaaccaccagaagctaaatagaaggagaccttttcctagtgccttcagagggaacatggccccactgacactttgatctcagacttctagtcttcagaactttgacacaatacatttctcttgtttaactcagtttacgttactgtgttacagcagccctaacaaagtcatggagtaaactctgggattaatccctttccccaacatttcataaactattctttatctacttagcaatgcattttggatattcttctgtgtcagtaaatatgtttctatgttatttctaatagttttaatatatatagttatttcccaaattaaaaaaagttaatccgttcactttgatatacattaatatactaacttgtctctaatttgtattaatagttaaaaattctgcagagtggtggtgtaatctggtttacatttgaagctattgattgtacttgttaactttcataactgctattttatatacttatatttcatgttattataaagttcttaaattggctaatttttaaaaacaggaatgaataacaaagaaataaaatataatcattcctaatggcagttatttttcttatgtattcatgcctagttttcaccaatgtgcatgtattttatctatttctaatatacatatatatgcacacacagacacacacccacaatgttctttaatttgatttattacttaatatattataaatatatttgcttttatagtacctttatggaatatttggaatccccatacaattttccatcaaatatatatgctcaaaatattattgatgtaactactccccattattgaacatttagtttctttttagctttaagctattggaatttgtgctgtagaacctataactatcctaaccataagaaggataggtcaaaggttatgaaactttgttgatcttctgtaattattttcataaggattttccataagcaagatgatagtgaaattgactaatttaggttgacaatttattcttgaaattagcataaaccagcagtatacaaaacagtaatgtagggataagattcaatttaatgctacattttagtaatcagaattctgattttctgaatatattgtgtcctttatcaggtgaatgctttcgctgttgatatgaacctcatctttccccattcctgcaacctaatgctttgtctttaaattctctgtcaattggcactaatttcttttgagacgtgttttggaaacaaataagatttttcttagtttaccaacttaactattttttccttaatctccacttatgataataatcttgagaacaaaagtatttagaaatgccctaggtataaatcccgaagagattgagtataataagccgtccatggtatttacacttggaaagcaaactttgactctttgccctttaccacgtagacttgatgcaaaaatcaatgagatgttctaggtttatgaatttgatttctttttatctttttcacaatgaaggaaaacaaatcaaattaatgttacaagtaaacagatttccgagctttgctacctaatgctgaacatctacgtacttcaaagacaatatagaatctttgagataaaatggcatttttttcccttatgataactgatattcaggattggaaacagtttgcctcaagaaaatgctgctttgcatactataaaatgccggtgattactcaactcttgcagtgttagatctaggagggaactcaagagttattccaatttttttccatgcagactcaataatgacattgagagaataacttttaataatacaggtatctattattaaaatgaaaatggcagaggacaagataatatgccataatctgcttcatcagtgttgtgtgtgtgtgtgtgtgtgtgtgtgtatcagcaaatattttttcagctaactaataggtgatataaaaaattggggttgtaagacctatccatagaaacaatcataaattactagccatagaatttatttgcctccctttggaagtttatttccttttgtgattaataacaaacttgagggtaggtgtatgtggttgaatggtaacaggcacccaaggtttggttacgtgggattgcatcatgttgcttggcaccacccagctgagtctccaaacagctagtttggaggcatgtgtctcgtgggcatggagtgttaatttctcttgcagcaaaacagaaagcggccgactgagagagtggaggcatgggtgtggttgaagagcacacaggagaaaagacggtgggggaatatcatttttttggttctgcttctactccagtactggatgccataagatattgcctactgctatggacattttattttaaaaagtagtaggagtttcagtatgatttattcattgtctatagaaatcctaatgtggattatgttcatacacaatatacagaagtatagatattaaatagtcaatttcataaacataatctttaagtaattgtgagtcaaaaatattcagggtccaattacaaggaaaagtacaattttttaacaatgctttatgtattttatttgtcttgatccaaggtttataaagtagtttaaatcctgtgcttacttaacttttctgtttatttgccaattaatagagaggagataaatgaaaaggatcagataggaagaagggaagcagccaatattgtcaaactaacaatggaaccaattgtacctgtgatgttatattggcgagtacagaaatattgaaaaacatattaggatttcaaagcatctgttttgcatatgagtaaacggagggttatgagatttcttcactcattacatagctggaacttatacccaagtccttatctccaagtctaatctcctatctttcttcagctatcttctgggtcttggggccagatttagggtgtttgaagaattatttgtttgcacccttaaactcatttgaattttgtaaactcttaagtatagtaacttcacattaggtgttgcacttgcacagggcaactttggctaatggttattggaaatgtggagtatgggccttctagggcactttccttagtttttttctttttctggagtgaggtgaggctataaaaaatagacaatattaaagcatatagtcgtttatgtattcaatacttttctatgccaacagatcctctcagtgtactattatgcaccttattttgcaaataagtcaagagaaaaaccgttttttccatattaaggaatcatataggacaggcagggtttatataaaattctgatagcacttagtaaagcttcgttctccctaaagtgggtacaatagaaggtaagctttggaattttaagagtattcactgttcatgacactgtttatcctacatttgtcacatatcattttctcaggatatctgacataacctctccaagatatttggtttaaaattaattggcagtcaatggcaaagggtagagtcacttaaatttgctgaagcaagcacagtagcatctaccagagtatatgtcagattgttctcagaccgccaagggcaaaaatatgtgctgagggaggctgtactggtgccactgtgttggaggccttcttcaactcttaattagcttgctatgagtggagatgccatcttgactggctctctgggaaccattaggcagggccactgaccttggcaactctaatatttatctctgtggaactgagttgtgaaactaaaaggcactgcacaggtgtttccaaatattttaaaccagcaatggagagactattaatttaggccattaaaactaactaccaatgtatagagtgacctggtacaggacactctgcaggtatcaatctacctttgggtcagtagcacagtgccccttgccttctgccaccacattagaggcatcatttttatttttagcctggacataacagctggttaaattatgtgaggagtagctcttcttgataagatcagcaaagatgctagaagtaagactgactgtgaaatagctgcagccaactggcctctcagccatcattcttatctcctggataaataagaagcctgcaattacattttgaaaatctctaatagtcagataggcaaaacaggacttccatggactcaggttgaaaggtttgattgtgagttgtgatttaaggccaaaggaagagaaatagccaagagagaacagtatagataggagacagaatctcagtaatgaactagcaccagaaaatcttctgcaaagaatatacacaagaaataatctccaagacacaggatttaagcttctgcattttctttctattcctaacagtgtgcctagcaaccgctgatatagtacaaattttgctgaatgtcagatcgagagctctggaaggtttatatctgcaggagattaaggtacaaatatttccagattcgtttcagggtggcaagatcaactcacagcatgaggcttctgtcatcatagagatgctttgtggtactttctcttctttcgtaaatgaactggcaaaattgccacttgagtcaaatggaagaaggcaaaatgttgtgttagctgttctggggagtgagtggcatgtttcctgggccagatagtggatccatattcagtaaggggactgactcagtgctctttgtggaactagaagatcagaaaacaactgatcatgcttacgttgtattcatgatggccttgaaaagaaacatttccacccattatgttaccactatattgaacatgcactaatagaatagaagtggaaatcatcagcattaacacagattaattttatgaaaggtcacagccagattgtatacatggacatgccataggatggaccaagataaatctttaccatttatttagttcttcattgctctgggaaacctatattttgtcagttacaggaaatatatagctcaatggctaccattagtttgaaaaataacagaggatatattttggcctgaaaggaacagaggtctaatgttattgcagctgtaataaagaactaagcgcctgaccttatgcttgaaagagttaccaggtgaagacagagctgttcacttaaagcactcagattcagaagcaatccttaaaaacaaaacccagaggaaaaccatttaataaacaaataataaggcatgctggagaggcagttgtgggagtctaagtgtagtcaagtgtttccgtcttagtgcttgttccacttagccagagctctgggtcacctgggatttgggccctgggaggggataacagtgtgtacgggtttagcactggactctgctgtgcattcaacttggagataccataggccaactggagctcacaggcttcacagcttcatcgatttttagcttcagtgaggataatagggagccaaaacaagacaatttcattgctccatctctgctacctcatttctttttcctcagtatgcatttagacgttgcagagagttcatgggacagacaaagaaaaccctttgctgtgttcacaaatggtccaagactgaattaagaatcacaatgatattttctctattagttaatacattatttaactttatattatacattgagtatttaagttgttttaagtgctgttttacttgcatatattaagacaaatattacctggttgatttccacacagtggacttttaaaaaatcattcaatcaagagctatcttggtatgaaggtaaggaagcgacaagcctctgtggtagacattgaacttttcatattttggatatatctgtcctcttttttcctttgagaacacacaagagaatccttattattaatttgttaattcagaaacctttcttgagtaagctacatatttttataaattcacacttacaaatcaagaacctgatactacctgtaatcctaacaaataaaattaaatctttctcagaccccacgtgccaatattcatgattgtcccatgacagcgagtggtgcctttatcttttacaattattcacgcatcaagcttaagtattttggtaaatgatggagacacgctcctcagtgccttagtcctccttggagaacatgggaagaaagattgttcttctgcaatcataagcagactgtggccatccaagaatccaagtatattcttaaacaagcttggtctcaccaaaaatagttgaatagaatattgcccagtcatcaagaaatcagcaaacattttaagcacctttaaagtatgctgtgctaggcattctgatgggatacaaaaaatgtgaggatacattttaattaaataaaaacaatatgagtttctgtcctcaagaaacttataattgggaaaagaaaacaaagtacagtattcaatttcttcctggttcagttttgggagattgtgtgtccggggttttatccatttcttctagattttctagtttgtgtgcattgaagtgttcatggtagtccctgagggttttttgtatttctgtggggtcagtggtaatgtcccctttgtcgtttctaaatgtgtttacttggatctctgctctttttttttttaattagtctagccactagtctatttatcttcttaatattttcaaagaaccaattcctggattcattgatcttttgtgtggtttttcacatctcaatttccttcagttcagctctgattttggttatttcttgtcttctgctagctttgtggttagtttgttctttgttctctatttccagtggttgtgatgttaggttgttaatttgagatctttctgaatttttgatgtgggtgtttagtgctgtaaacttttctcttaacactctcttagctgtgtgccagagattgcgttatgttgtatctttgttcttattagtttcaaagaatttcttgatttctgccttaatttcattatctacccaaaagtcttttaagagcatgttgtttaatttgcaggtaattgtatgggtttgagagattttcttaggattgatttctatttttgttgtgctatagctgttgctacaattttgagttttttgcatttgcctgaggattgttttatgtccaattgtgtggtcaaatttagagtatgtgtcatgtggagatgggaatatgtactctgttgttttgggttggagagttctgtagatgtcttttgggtccatttggtcaagtgttgggatcaggtcctgaatatttttgttaattttctaccgcaattatctgtctaatgctgtcagtcgggtgttgaagtctcccactattattgtgtgtaaatataagtctcttcataggtctctgagaacttgctttatgaatctagctgcccttgtcttggttgcatatatatttagggtagttagcttcacttattgaattgaaccctttactgttatgtaatgcctttttttttttttatccttttcatctttgctggtataaagtctgttttgtctgaaatcacgatagcaacttctccttttttttctgttttccatttgcttggtagatattcttccattcctttatcttgagcctgtgagtgttatcgcatgtgaggtaggcctctcttgaagacagcatatcattgggtcttgctttgttatccaccttgccactctgtgccttttaattccaaggacatgaacagacacttttcaaaagaagacatacagtatgcagctaacaaccttatgaaaaaatgctcaacatcactaatcattagattaatgcaaatcaaaaccacaatgagataccatctcacaccactcaaaatagctattatgaaaaagtcaaaaaataacagatgctagcaaggttgcaggaaaaaagggaatgcttatacactgctggtgggaatgtaaagtagttcagccattatggaaagcaatgtggtgatttgtcaaagaacttaaaacagaattagcatttgactcagcagtcccattacaggttatatacccaaatgaatataaatcattctgccctaaatacacattcactgcagcactattcacaatagcaaagatgtagaatcaacctaaatgcctatcaacagtagactggataaagaaagtttggtacatatatacaatagaatactatgcagccaaaaaaaaaaaaagaacaagataatgtcctttgcagcaacatggatggagctggaggccatcatcctaatcaaactaattgcaggaacagaaaactgagtactgcatattgttacttataagtgaacacatggacacaaagaggggaagaataggcactggggcctccttgagggtggcgagtgtgacgaggtggaaaatcagaaaaaatatttggtactttcttattatatgcatgatgaaataatctgtacaccaaacctccatgacacacagtttacctatgtaacatgtttgttaacctgcacatgtactcctgaaccaaaaatgaaaatttaaaaaaaacaaaatatgaacaaagtcccaatgtaagagacaaatatcagttcaattaagtacagatattgattaaattggtagcaggaataataaatacttcagcagagtagaagaagaagaaatggccatgggctatcctggcctttaagataaatggaagaaaatgaatatgagcagtatcctgaaggattggtaagatttacaccaatttcattccgagcggatgttctagcatgcacaaaagtaaaagcaggaaaatgtaaaatcattaggtatgatgatgatagtagttaacttttattgagtacttgagagatcccacgtaatattgattaatctgcaccagaacatctaagacaaatttaagacatgccagtggaaaagcttagccacagattcgatgtaggtgataaaaataaagggaatgagaaagctaaacattgggagaaattagcaaaaactccaggtcttcaagactgggtagctggaagaacatggtatagatctactaatacgagtgtcttttgacagacctggtttacagagaagagatcagggttttgtatgatatttatttatttatttatttatttatttatttatttatttatttattttgagatgggatctcattcttgtctctcaggctggagtgcaatggcacgatctctgcacactgcaacctctgtcccctgcattcaagcgattctttggccacagcctccctctagtagctgggattataagtgctcaccaccatgcccagctaatttttgtatttttagtaaagatggggtttcgccatgttggccagtctggtctcaaactcctgacctcaggtgatctgcctacctcggccttccaaatactggaattgcaggcgtgagccatcatgcctggccatgagataatttttaatgaatttaatggaatgattcaagaagaaatattcagtaaacatttagaaagttgggaactgggattccagagaggctcaactggaaaaacacttaatagtcaaatgcctagggaaggtagcttcattcaccagaatgaaaccaaaaattgtgaacctcctttagaagttttacatctagagaaccatgaaacaaagtgaattttcatttatctttaagtccaaagagaacttaataaccctcatgtttctcatgatactgtccaaaatccacagatccccaggaaattatttcttgttttcacagagacatgcgtattaaagctaactgaagaaggcaaaaaggaaaacaaaatgactgtgaacagactaggtgtatctgttctgttcatatcctttgcccactttttgatgaggttgtttgttttattcttgtaaatttgtttaagttcctggtagattctggatattatccctttctcagatagattattagccctttgtcagatggatagattgcaaaaaattttctcccattctgtaggttgcctgttcaccttgatgatagtttcattgctgtgcggaagctctttactgtaattagatcccatttgtctattttggcttttgttgccattgcttttggtgttttagtcatgaagtgtttgcccatgcctatctcctcaatggtattgcctaggttttcttctagggtttttatggttttaggtcttacatttaagtctttaatttatctcaagttaatttttgtataaggtataaggaaagggtccagtttcagttttctgcatatggctagccagttttcccaataccatttattaaatagggaatcctttccccattggttgtttttgtcaggttcttcaaagatcacatggttgtagatgtgtggtattatttctgaggcctctgttccattccattggtctatatatcctttttgttaccagtaccatgctgttttgtttactgtagacttgtagtatactttgaagtcaggtagcatgatacctccagctttgttcattttgcttaggattgtcttggttatatgggctctttttttggttccatatgaaatttgaagtagttttttctaattttgtgaagaaagtcaatggtagcttgatggggatagcattgagtctataaattactttgggcagtatggccattttcatgatattgattcttcctatccatgagcatggaatgtttttccttttgtttgcgtcgtctcttatttctttgagcagcggtttgtagttctccttgaagaggtcctttgcatcccttgtaaggtgtattcctaggtattttattctcttcgtagccattgtgaatgggagttaactcatgatttggctctctgtttgtctatttttggtgtttaggaatgcttgtgattttgcacatcgattttgtatcctgtgactttgctgaagttgctgatcagcttaaggagatttggagctgagacgttggggtttctaaatatacaatcatgtcgggttttctaaatatacaatcatgtcatctgcaaacagagacaatttgacttcctgtcttcctatttgaatactctttatttctttctcttgcctgattgccctggccagaacttccaataccatgttgaataggagtggtaagagaggcatccttgtcttgtgctggttttcaaagggaatgcttccagcttttgcccattcagtatggtattgcctgtgggtttgtcataaatagctcttattattttgagatatgttccatcaatacctactttattgagagtttttagcatgaagaggtgttgaattttatcgagaacttttctgcatctattgagataatcaggtggtttttgtctttgcttctgtttaagtggtggattacattgattgattagcatatgttgaaccaaccttgcatcccaaggatgaagccgacttgatcatggtggataagctttttgatgtactgctgaattccttttgccagtattttattgaggattttcacatcggtgttcagcagggatattggcctgaaattttcttttttgtgtttgtctctgccaggttttggtatcaggatgatgcaggcctcataaaatgagttagggaggagtccttctttttctgttgtttggaatagtttcagaaagaatggtactagctcctctttgtacctctggtagaattcagctgtgaatccatctggtcctgggcttcttttggttggtaggctattaattactgcttcaatttcagaacttgttattggtctactcagggattcaacttcttcctggtttagtcttgggagggtgtatgtatccagcaattcatccatttcttctagattttccagtttatttgcgtagaggtgtttatactattctctaatggtagtttatatttctgcggtgtcagtgtttacatccccttggtcattttttattgtgcctatttgattcttctctcttttcttcttattagtctggctagtagtttatctattttgtcaatcttttcaaaaaaccagttcctggagtcattgattttttgaagggtttttcatgtatctatctttttcagttctgctctgatcttaggtataccttgtcttctgctagcttttgaatttgtttgctcttgcttctctagttcttttaattttgatattaggtgaacagacacttctcaaaaggagacatttatgcggccaacaaacatatgaaaaaaatctcatcatcactggtcattagagaaatgcaaatcaaaaccacagtgagataccatctcacaccagttagaatggtgatcattaaaaagtcaggaaacagcagatgctggagaggatgcagagaaataggaatgcttttacactgttggtgggagtgcaaactagttcaaccattgtggaagacagtgtggcgattcctcaaggatctagaactagaaataccatttgacccagcaaccccattactgggtatatacccaaaggattataaaccattctactataaagacacatccacatgtatgcttattgcagcactattcacaatagcaaagacttggaaccaacccaaatgtctatcattgatagactggataaagaaaatgtggcacatatataccatggaatactacgtagccataaaaaaggatgagcgtatgtcctttgcagggacatggatgaagctggaaaccatcattctcagccaactaacacaagaacagaaaaccaaacaccacatgttatctctcataagtgggagttgaacaatgagaacccatggacacagggaggggaacatcatacaccggggcctgtcgggggagtggggaagctagtggagggatagcattaggagaaatacctaatgtagatgacaggttgatgagtgcagcaaaccatcatggcacgtgtatacctatgtaacaaacctgcacgttctgcacatgtatcccagaacttaaaatataataaaaaaaaaatgccaggcgtaaagcaagcagaatctgtcagctccctttcattttagaggtctgtggagcatgttgtacaggtttgcattaattccttcagaaccagagaaaggtatcacttaatggaaaacattactgattgagaaatggtatggtttttttgaggtctaatgcaatattttgaatagagaagaatgtcagctcaaaatctaaaatgttatatgaatgtcaggagaagaaaagtggctgtatatgtttgtatatcatgtgtgtacttgagtgtatgtaggcctacacatgcacacacaaatacacacaagattttcttacgtttatccacatgataatggatcaagaccgtttgtgatggccaaagatgcacaaatttatatgaacacctaaattatgttaggatgggagtgaatggaatgattttcatcaccttaatactttgtaatgatcatgaaaggatttttgaaaaaaagaaaaagccctaatgatttttgaaaataataatagcagagggaatcccatgcaaaatcagtttgttaggcatgtgaagattttaagtaatgcagaaaagtaaaaaaaataccttccctaatggtgatgtacagaaacatgtttatcatcaatgcttttataacttttctctcatctcagtttctgttagagaattatgcataatggattgtgtatttaacaggaattcctcgattgcaatggctttttaaaggtttttttctttagttattaatagaatctttcatttacagcctaaatattgctgtcatcttagagaaacagtgaagtatcagagaggaaataaaatgggataaaatggatattcagaatgtcttgctacctgaccgttacttaaaacaagataccttttctttcttttcatgaaaacaaaactatttgtcttcactatccactctgttaaggaaaataattttctcaatatataaagtgaggcatagagcatacttaaggtaaactaaatcttaagataagtgaggccagagtaaaggagcaccaagcctcacttaaatgggttcatagatctaggctgcagtctgttactgttgaaacacatgatacttttacaaacataacaaaacaaaaaacaagaacattcaggtgtttcagtagaaaccgacagaaaagcgttttaggaatgctgtagattagggaaaattccagagagctcacagaacaacaacttcacttcttttgacttttaaagaaaaggtaaaagaataaattctggaaaatacagataccaccagaaacatttgtctgcccttgtaaattagggaatataggtttggtacctacagagtacaagacaaatgctcatcatgttgtgggggaagcaaaatttaaaaacatgtggactctacctaacctcagagagcttgcatgctaattaaggaattaatatgcaattataaattggcatttgacaagtagcactggaaaggcacagaaaaggtgatttattattcagagaagtggtaactttgatctgtggacatctagaaaagttatctctttggaaggtgagctgggtatcaaagagaggagactttattttaaaaggcaggtatggggtggagaaaactgtcaaaacaaagctatgcaggcagtataatattgcagcaagctgctgaatggaaaaaccaatttgatggaacatggttggatgtcagggaaattgggagatgtgttcagaagagtcagtgaaatttgactgcagatggtctatgaggaaggtgacgtgctacggcatggcgaagtgtgttgagtaggcacccggagactagagtttctgttagtctctgtcactcactcactgtgtgtacttgaggaccatttgacctccttggcaagtacacgtcttacctggaaaacgacggtgtctagttggagaccagtgtatcaactcacggtgattccatacagcaaatttttcttccaggtttggggtagatcaccaggttattgattaaacaccacacaaagtaattggcttgagtttaggaaccatgttttgaaaaaactgttatatctttaaagagaagaatcatcctcagcctggggagatactcacattatttcagagacacaagaactgaaacctcccatgagaatggtggactgggtttgtatgttccaactagcactcattccggggcatgtgctatctacagcgttctgtctctataggtatgttttgatgtgcttgtttttatcctttttcacagcacatatagtggaattcatttaaattaatatgtaagatgcatttgggcctttcatctcaagaacaagaatatggaaaccaaagttatttaaaactctagtcaaaggactgccttgaaataagtatcaaaactccaatatcaactttggcttcaaaaaggaacctaaaggcatttaacagtgtgtcctaagggatcaaatgtcaaatatgatggttactaacacacaggaagaaaaggaccagagctagaaaccagcagtaatatcttccagtatttttgggggagatggaagctgaaaaggatgaggaagagaaaaggatatgaacactgggtttcaaactaactttgctgaattatggaaagagaagaaatatttatttctgctgatatatcatgaaaagttactattaactgaattatttcttttcatttcactcttttctattaaactaatgatcaaacaggttggttctagccacttagaaaatgatgttgaatatgtcttgaaccaaaccagtagacgagttagtttaactgtatgaattaacaactaaagaaacacaaaatgctcatttttaccaggagttaaagctatgtgttttctgtaactaccaaactggaataaaaaagttatctcaataatcggtgtactgtatatgaattgatatctcatttaaattaatctacatcacaaaccttgttcagctttactcctgtctggccaaaattaatctttataatgaagtaccttaggtattttaggataccagtatgtattcaagtgagcgaataaaaattcagttgtctttgctaaaatttctggcatgtttagtgttttaataagttatctatccaaataggtattttaaggtattagtttcagacttccttttggtaaatgtgtttatatttgtaagttttaactggctagttttataacatatattaatttctaaacaggatttagagcaaaaaaaaacccaaacatactttgcttagtccacatttcactttacaaagtaccactggtcagctcagtgatactttctccagtttgtgggtcatttcatcctgcatttgtacaatgattttgagtaacacatcagtagtgaggccagctgattttgttatacccagagaagacttttaaattaaagcttgagaacagaaaaaaaaattactgaaaattgaggatcagcaaacttttcttgtaagtgggtaggtagtaaatatatatattttttattttataggcgatatgatttttgtcacactacttgcctctgctatagtatcacaaaagcagtcataggcaatgccaaaatgagcaagcattgatgtgttccaatattacttacaaaaatagatgttagactttcggcctttgggtctgggatttggcatttaggccataatttgtaaggaatttggccaaagctcatagtttcctagtcgttgctaaacatgacaggggccccaaatgaggtcccaaaatgagttctgaagaacgtttgtcccatgggattttcatggatgaaaaagtaaatctaggaaatgctgcacagaatgcctttcttcttacacactgaaattcaatgtcatcttattaaaggctataagacatcttacaataaagtgatctgtctctgttggctaactcagttccccagaacacatgtgaccttgaaattctttttgtcatagataatttgagtatctgtgattcagaaacaagtttccaaactgatcatttggatatctatatagattgtcatatgcatatctttattgaaatatctttttaaatccgagtcaacttcgtgagtcacttatccacaaaggtaaccaggaaaaatactaaccttcttaagtggttctggataatttcctgattagtcccttcttaggttctaacacattagctcctgctgacaatttgagccgttggccttattctgctttttcctcggtaattaaatccattgtagtttaaatcagttcaacatatatttaccatgtacgatattttccaagcacaccgattaatgaatgagagagaccgtgtctctccctttagggcatggatagtagcaaaggcataaagacaaaggttagaatattatgtgataacttctctaataagagaaatcctgaatgctgtcaaagcacatatgagaagtactaaactgttattatgaaatcagagaaagcttttagcctggagttcatctaagctacaaatttgaagctaatcacagaagggaagagagaggggaacagcaggtacaaaggtaaggagacaagattctctgatgtatcaaggcagtgcatagtacaactctaatatagatttatgctgcagagatgggtgagagttggattaagcaggtttttactgactttgtgaaagtatgtaaggtaggtggaaagttggaggcttgatcagagttgtactatggtaatatagctgtggctggaacgtggagaatggcctggaggggcacactgctcagaagtgagaatttctgaagctgttatgaagctttcccagggaatctgccatgggtaacctattaccccaggttcatcccttagacagataaggtgctgtcaagactcctaccttatgacaagaaaccaagagctacgtaatgtttttttccctgaaaccatctgtttgctagtgtaaacattaaactgtctttccatttgggggttactggaaatatcataaaaagggaataattttagactttttttaaaaacttgaaaggaggctttattatgtatttatagcaaaacaaaaattggcaccaagaggctagcctgagttttatacctgaaggaaatgtggaggcaaacctgggcattttccttgacaacagcaattaaccaagaagagcctcaccttaacgtctgttttaagacagcagaactggtcggcatatgaatatacaaacgtttaattacacaccctgcctgtccttgtgaacctctgtggtttacttacaaacgcatgagttatttcacgaagttatcctcaatcaggatgcagcatagtgttgtgtttactacatatgaaacatgcacaccttatccagtctgacacactgaagcacttaaaaggatgtgcagtaggtttttttataaacaagtagggtttttataaaccattttcttccacacaacaaattatactgttaacagctcggccctggtaagttttatatatgtgtgcatatataaattttatatatgtgtacctacaaacacacatacacacacaaacatataaaaatcacattttatatatgtgtgtgtatatgtatataatacatatattatttggaagtgtgatttctgtatttttcctgtattctaaccatatgaggaatgtctactcaacattgcttagaaacacaagttctaaggtccaaacttaagggtgtgtgtagtttagttagtggctgctatggttgttggtggagagtcagatgttgaaaagaaatggaacaaagttttttctaaacttgaaaatgctgtcttgaaatttgcagctaagatgtagtaaaagaggggctggtaggcaagaaaagaaaaactgtatgtaggcatggatcttaaacaaatcatgaaattgaattttcctaaagcaacttaaactatttatgattttctttgtcctttgccagatctctgaaatagcgtcagtctcaaaattcatgttatcactaattaggattctatcctcagattttttttgcagatgattcaactatttcttagtttccacagataactaaaattactacagtttctcctaccaacaataggcctagactgctaatccaaggaggaaatttgatgtcagaaaaagacacaaacaaagcaaaaatgcagtgttaacagttattcccacttttatctttctttacatagatctcacatcgcattgcaaggagcttacgctagtagtaaataagaaatttaggggaaacctgcatgctgcatttttagcatacaagaagtacaaaattctggctttatttttttcttcattaatatgcatggtaggccaggcatggtggctcacgcctgtaatcccagcactttgggaggccgaggcgggcagatcacgaggtcaggagatcgagaccatcctggctaacacggtgaaaccccatctctactaaaaatacaaaacaaattagctgggcgtggtggcgggcgcctgtagttccagctactcaggaagctgaggcaggagaatggcgtgaacctgggaggcggagcttgcagtgagctgagattccaccactgcactccagcctgggcaacactgcactccagcctgggcaacagagcaagattctgtctcaaaaaaaaaaaaaaaaatgcatggtaatcttggttcttttcatacctacgtttgaccgttcagcagtctaattttaattaaatcataacaaagtaacaacattgactatattgattgcatcttgggaattcagaatttattttttcacataatttttcctatgactagctggtcttctgtaggcaaacttttatgatccttgaactttttctggaaatgatgcagcaaactataaatataaaatctgcaatggtatactgtatgtacatatctttcaaggaggatagctccactgatgtaaaaacaaaaagatattaaaaactctgattttcaagctagaaaattatttatgcaccattggctttattttaaaatacatacttgcagaaaagttgcaaaaatgtcagcgtttccatacgcccatcactctgattctactaatgttaatattgtacgtaagtatagtatgatcaccaaaccagaaaactgacattggtataacactgttaactaaacaacagaccttattaggggtttaccagtttttccataatgtccaggctgcaatccacaatcttgcattgtttatagcattcatttcttcttactcttcttgagtctgtgccagttcctgagccttcgcctgccttttgtgatcctgacacttttgaaaactactagtcaatcttgttgtagaatattactcaattttctgatgttccctcctttttttttattgatgtcatgcattgttggcaaaataccatagaagagtattatgtccctctcagtgcaccctatcaaagggcacacgaggccagtatgtcttatcactagtgatactaattttgactatttggttaatatggagtctactgagttttcccagcatgatattagtgttttcccacattagctttagacaaagacacataaattcttaatttcctaaatatgatatactcactatactcttttatgcctcagtttccctgcctaaaaattattatactgcaaccctaaccctcatctcaaccagtgtagtaagaattaatgtgctgtcctttggagattcttggataaaactcactgtataactgcaaatgatcactctatctcattttaaagaagaacataaatagaatggttaaaagtagattggcagcatgtactcatttcacacccagaactacagagacatctgttatatatgtgacaggccaggcctgaaatctggttctctgagaaccagttagtgtttgcccgatttggcctaagtcagcctgattaaacaaagaacatatttatcacttgctacctaacaggctattacactaactagatggataaccacccattgataaggacaataaataactttttaaaaactgtcacattcagggtttctgctgttcatataagagggaaaaaagtcccttgacatactaaggattctggatccatgtgctgtaattctgtcatattagtttgtatctgataatgaagtaccccaccattgcagagaatggcaaacttcgcaaagtgatttactggctttctactctatttttatttttgaatgtcagtactatcagccctgacacaatacactgggaggaaattggccacttacaggtctagagggaagtaggtagggaaaggtatactaaagaaataagggactcacataatcctccaagccccgctttcctctttgacaaatggaaataatcatatacctgcctcctcaagttattgtaagcatttggtaatctgtccaaaacctttgtattgtaactgacccatagtaagtactcaagaaaaaaagaaaaaggttgtcatttttatcactttatcatctttcatacctgagacccagatttgggtgcaaaagacaagaaaatggaggtgaggctctcataaatagtgtggtttaatttgcagaaggcttctggaaaatgattttataccaaataagaattcaatagcatttgtcaaatggggtggaaatatcccaccatctgcatgtagtcatgaactaaagcatgatgatactgaggtgtacttctgctctttgagagtatgtgttcataggcaaataaacctagaaaatgaagaagaatgcaagctccatgatagcaggactgaactttaccgtgatacccagtgcttgctggtacagtgtctgacatattgcatgtgttcaacgaatattttcagatgaatgttctaatagttagctataaatacataatggcacaggatcttgaatacacagtttatttaccattacatgagatgggagatcccatattatagtttagctaaaaagtagggggatttcctgtcccaacctccacttatattgttattattattattctttttctttttcttttttttttttaagacagggtttcactcccatcacccaggctacagtgcagtggtgcaatcatggctcactgcagcctcgatttcccaggctcaggtgattctcccacctcagcctcctgagtagctgggactacaggagtgcaccatcacacccagctaactttttgtatttttagtagatatggggtttcaccatgttgctcaggctggtctcgaatttctgggctcaagtaatctgcctgccttggcttcccaaaatttggggattacaaatgtgagccaccatgcctggcccactccacttattttaagagaatgacttctgacttccttctaagtaaaacaacacttatattatgttccttttgcattatggtggtaaccattttacttgtgttatctcatatacttctctacaaacttctgaagtaggctcagtatctccgttttatggacacaaaactggaggatcagaaataacttgcctaaaacaatacaagtccaagacttgaacttaagtctatctacaaagaccatttatgttcttgactgatactgttgcatttgtgcactgttgcagccctcttagagtattatattatcttcccccagtagagtaaaataatctccatgagggaagaccctgtcttattcattgctgtatcgtactgcacgtcagttactagatgttcagtcactaatttgtaagtaaaggatagagtgccgtagtagattttatttaacaccctactttggtatagcctattacaacttcagtttttatgtttgaaatcttatttctgcttctgattaagcagacatagactcccttttaggctaccagttatctgattttctgatgtggctgtccgagcaatcagcaagctgtgcgtaatgatggacatactagtaagcttacttccccactaagtgtatccaagtaaaagccctgaaagtcacacggttcttgccacttttaatctgacacctaatatattaggtattagagtgttttgtgcttacctttagctcttctttagtttaggtgattaaaaaatgcctgttgctgtctgtatgtgcagcatgcttcattaacagtcatttatttgggaggttagcagaattggcactctgcagcacaccagcgagcagaaggaaaacaaacgtgagatgattgctaagaaatccttctttcctgctctggtgatagaagctttaagagtttgcaaagtttacttcccagtacccagaaagcatgggaaagagcagggtttctggggattgcaatttcccccaagtcccttgcatccgctctcctccagtgctcagtgggaaatccaaggggtcatggatttccccctttggcacggtgtgctccctgtatttgtggtctcccagaaccagatccttccactgcttgcccctcttgttttttccagcaagtttgccgactcaaactttttctagcagaatccaattatatggattttctctcatattcctttcaacaaccctgtattttcactgtcactttatgaaagaggaaagtgaggctaacagaggttaaatgacttgcccaagaacaacagctaaatggtagagctgggatttaaacctggcttgtgtgattctaaagccaatgatctcattgccatagggaagcaaaggaatttttattttacttgaaacctgtattgattttgtcatgtgtacttgaaatgccatgctgagaggattctggggctgcccttgggctaagcagcaaagagtgccataatcaattagcattgctttccataggagtgggacagaggagtggaggtgccatgtattttcctgtcttgaactatgatctacttttgttcttgattttattgtaataagactgtaataacacgggaatgacattctaaaggaaggatgaagtatctgaggggcaatctaaatgcaagatgaaaataccacatattttatatataaactacaattgcctgctgttctaataataaggctacatatacctatttgggagaaattcaacagagtgtttaaatatccacaatcttaagtcaaacttcataatctcaacttttattttaaattcagggggtacttgtgtgggtttgttacataggtatattgtgtgatgctgaaattaggaggacaaatgaccctatcacccaagcagtgagcatagtacccaataagcagttttcagcccttcctcccctccttctctctttgttctactagtccccagggtctactgttcccatctttatgtccctggatatgcaatatttagctcccacttgtaagtgagatcacccagtatttgtttcctgttcctgcattaatttgtttagtataatggcctccagctgcatccatcttcctgcaaagaacatcatttcattcattttcattgttgcatagtattccgtggtgtgtatgcaccaaattttctttaatccaccatcgatgggcacgtaggttgattctatgaccatgaatagtgctgtgacaaacatacaagtgcatgtgtctttttttttttaattatttcttttcttttttttccttttcttgtttttgagacagggtcttacactgtcacccatgctggagtgcagtggcacgatcttggctcactgcagactccaaatattgagctcaaacaatcctcccacctcagcctcacaagtaactggggctaaaggcaggagccaccacggctggctaacttttaaattttttttttgtagagatggtatccccctgtgttgccctggctggtctcgaagtcctggactgaaacagtcctcctgcctcagcttcccaaagtgctgggattataggtgtgagccactgtgcccagcccaatttatttttctctgggtatatacccagtaatggaatttctgggtcaaatggtagttctgttttaaattctttaagaaatctccaaactgctttccacagtggctgaactaatttacattcccaccaaaggtttatgagcattctcaggattcattttgggagtgatagaaatattctacatcatgatggtgatggtggttgtatgactgtataagtttttgaaatctcatcaaactatacataaaaagaacgcatgtcagtgcataaaatatacaataaacagggaaaatcagagaaagttctatctattacttattaatttcaacttagttaacccataaaattaaaatcatattgttgtttaccttcaaggtttttttaaagattatatgagttaacaaataatacagaaactactatatagtaaatgctgtttaaatggtatctattatttatcatttcaccagttgttttgtactatattctaccattacgttatctccaacattgtttgccagtttaatcacatacccttttatgttgctgatttactacattgtactgtatactctcacaaatacataagcttcatatgtatggataattgtgagaaaaatcatagctttgaatacatggctcttctgtgtttaactaaacaatgttagaagactagaaccattcatgtctgtttttcaactgaattgctgaagtgttaagtatctatatgtccaaataaataatacttattaaaaatgatggactgtaaggtgtgtttaaaaatattgaaagcattagctatgatagaatgtttaggatgaatttgtggtatatacttagaaacctgttattaaagaggaaataacagtaactcagaaaaaacaagtactataaaaaaaaaaagaaaagcagtatactctcaagctcagctaacaaattaccaaattatgtgctataactaagtttagacaacagtgaagcaaggtatgtttgtatttgtgtattcctgtctgtcattgggaatgattaagagagttgaatatcatcattcataaaagaacttagtacatatgacaaaaaaatcaagaaatagtagtataagcatgttattttttcaaattatcattgttgaactacttaacagaaaagcagtttgttgcccctggacaatatttacctatggggactaacagctagtatttaagctatgttcaagcattcctttaataaaagtaaaagttaaataaaactttaaaaaattacaataagtgattacttagtgaaggctgtggatagtgaatgtggacttgtggcttggagttaaattttcagtaacagtttaatacatagaatttaaaagcaatatatctaaaacaattttaatggatgggaagatgatataatccgaaaaattgttacaagcctcaaatggctctagggatgacaaagacatagtctttacttcatttaactaattaaatatttttggcatatataaccttcttcttatagaataatgtaattcaaagtttcaagaatccttaaaaacaatctggcccagtcccgtcttctattcatgaggaaacttgtccagcaagcaaataacagcactgagcctggaacgcagttattctgaatcttatcccagtgatcttttgaaatatcactgtgattattgaggttacttccgttttttgaagagggtcttctcggtagcaaaatataaaggtccaacatcaaaggtagaataaggttttctataaggggaaagtatattttgagaaatccgtagtgggtttatactttaagaaatttcaatgaaagacttttccaaattaatccgtataactgtggactctcgggctatggaagacatccttcagtaagtgaaatgatgatacattagctacctggcttttatttcagaggatttctgcctaatgtactcatatttatggttagaatcttcacaagtggaaagtcttttaaaatggggagcaactgtgtaccttagctgaccctccatcattcctcaaggtcctctttaatgtggtattatgatattatgatggaaacggtgtctaaatcaaccattgggtaggtgagtatggtctaaataagggattccatcctatacatgtctgcctcttgtttaatagatgtagcttcccgaatatatcatccaggtcccttatgtcttcccctcttttgcactgttctattcatattttcagatgcttgggacaaataatctaatgataaaaaccaattaacacatattttctcatcattcctagcagactacttactgcaatctccagtcaagtttgaaagacatcacctataggaatgaaaatctgtttttactggtagatagagtataaagctggttaaaggagaaaatccagcaagttatttgattgactgatgtgataggaattttcattatccaagaagaacctataggctagctactgtaatcacaggacatacagatgacctgaactactcatttgacatataaactatatcttgtatggtcaataatctttcctatccaattgagctgtagtgtccttgtgggcggagaccttgacccaaaactcttcatattttgcattttaccaattgaatcatggacattcaacaaatatctattgactgattgaacattaagattttactgtatgccattttcctttaaaattattggcatattgctttctgaggaagcctatttaatctcttgctttcatttctgtttcccgcttcctcgccattgtgattgactgcacccctcattagctaattgtagagttaggaaactctcaactctacagatgggaactgtggatgatcctttttaaaaatctctgccttcagaatggtagcactctaaataataactagcaagaaagcaaatgtttatgttgttcttacacttaggaggaaagaaacttattcacagttatgctatcacaaaagacttctgaattaacactagtgaaacgtagccttccgacaaagtctcagctctgaaacctgtgctatcctttacattatgagtattacagattctgcaccttggcttactggcacctggcttcacttctgcagaaggacaacatgaaaagccaagttagagagaaaggagtcaccatcaggatgttatctcacacttgaaaagacacaatacttttagaagagttcattacctttagaaactagttcagtatttgaagtatgaagacatagatttaaatactggctctattgatttctagatatttaaccttggacgagtttcatagcctctcatattctaattgccaaagctctaattttatagaggatgatgatgcctgactcccagccatgttataaggattaaatgagaagtgaatgtaagatcacgtggcaggtccacaagagatgttagctgcctttattctttcatttacatactagctgttgattggctgcctgctctggtggttcactattctatgtgcctctaaaatgtcaatcaagaatacaaagattcctaccttcataaagttaaaaatctatttggtgggggccaggaggcagaatttgaatccaagtttaaataaacgatgatagttaatgctcacatacaaaacaagccagtggaccttcacagcacacttgtaagaaagatagggcttctggcatgatccctaacctacaagcaagcaaacatgtttacagagattaagtgtctttcccaaagtgaggtaatttgtagtaaatccaggaagaactcagtgtgcgtgaatccgtgttttcccactctgtcttgctgctatgaggctttgaaaaacatactctgttggaagtattcttagtaattagagatgtagtcaacttgctaaccagaggagaaaagcaaaaaaggtaaaatagatattatgtccttcaggggattgcattttaagcagatcttcatacaggaaaataaaatctttttaggtctttcccttcttgaaagtcattctcaccctcctcgtagacttcagaatcaagtccagaattttttttttttttctttttttcagacggagtcttgctcattgtccaggctggagtgcagtgatgcacgatctcggctcactgcaacctccgcctcctgggttcaagccattctcctgcctcagcctccctagtagctgggactacaggcatgtgccaccacacccaactaattttttctatttttagtagagatggggttttgccgtgttagccaggatggtcttgatctcatgacttcgtgatccacccacctcggcctcccaaagtgctgggattacaggcatgagccaccgtgcctggcctcaagtccagaatctttaatatacgttcaaagatgattggagaccaggctcttgatttaccttccagcctctttccccctcagcctataactcccaaactcaggctgcgctgtgctgtctttaacaaagatagctatgacgtttcaactttgtgccagtacctaagctcagtgctttccatgcattctcactaatccttaccataagtttggcagatagatatcttgctgctcttttatagatggaccacacagctggagagtgggaagtctaggaatagagcacaagttagattctgcagtctacgcttttcattttcttgcactgctgtaacttaaaggttctcacagcttcttgccagtttgttttccttgtcacttggctcagaatggccttcctccctcttatttatcctttaagaatcagttcaaaatggtagcccctttgaggagctttcttgaaactcctgccctaccctacctcccagctcagttcagtgataatcttttgcttccttaacatcttgttcttaataaacttactgcacacattgcaccgaattataatgactggtttattagcacctcctgctaagtaaactgtgagctccttgaggacaagacccgcacctccctaacctctgcacacccagcacctagcaccgtgcctgccacatggtaaacacgattactttttttgttgagctgaattagtactgtttggataccagcaacattttaattcagcagagtgttcaaaacaaataaatacatgaccaggccctgcatgtagattcttggaaaccaggactcttaagggaaaactgattcatgcttttgttttcagcactttgtactgaggtcttcagtgtcactgttagtatgagaattgtttgaagggttgagggaagttttgttctgtgcaagaatgtgaaaaaaaaaaaaaaaaaaaaaaaccaccctgtacaattctcagttattcatctcctcctggctcaatgagagaaagcaatcgaggcctgttttattgtgtagcttccttcttaggatttacgagtctcattcttgggcaggatctcaaaatgagtgctgagtacactacctttgctacagccactgttggataagccagagagagctcacagctgcaggggagatctattgccaccataactcttggctcatcctgcagctttctttctgactctgacagaaaaattgaaattatgaaacttcgtatcctgcaccagagtcccacgtgagattcatgaatcttcagctcccttcagaaaaccggatgctttggttaccactgcccactgacaaattactgtccacgaccccattatttctgattagcaaaggtgaaccttacctacctgaatgtaaataaatgccaataggattcgtgaaattcttcatccttaaaaatctacagcccttaatagaacatgcactgtaaatactatcatatcatgaactaaatctttatcaggtaattggatacatttcctaagctaattttaattgcttccagaaactgcttaacattgtagatcaatcccgaggtccgagatgacatttctctcacaaaattaattattaataccctgatcatttgcttaagacattaatagttttcattgatcagcacgtcctgttgatctaaaatggcctaatcaccatgcatgtcagaagagtatctgaacatatccaattagagatacggccagctttctgccacatcagcagatccgaagttaagagtcccttttgtcttcacaatatattaagtccagctctatcagaaactaagctatttaagggcacaaaagaaaggcgagttctctaatgatgcttgttcattttctgttagctccctggtaaacatacaggctttgcagtgatcacatggtgtaaattaacgctaagagcccattattaagtagcttgtgttggcccatgttttcatgtaagcctgtgtttgctcacagtgtttttcttataagtgggagtaagatgagaaacttcaggttattttcagcttaaaaatattggggctcccacagtgtgtacatatatcaaaatatcacattgtataccataaatatatacaattattatttgtcaatttaaaaataatataaatgtaatatatttttttacatgaaagctaaaataacaagttgagaccacagtaacatctggcaatgtagggtgctgcagagttttcaaagaagtttcatttacttaaccaggagttttcccttgaaacaagattcaaagagaggctaggtggagtggtctacctaggaccacataacaagttcctgccagagttgtaaatagaatgagatctcccggttccataaatttctggtttatttgattgactgatgaataggtagcactctgctcatctttcagaccccaagggaagctcacctcctttgtgaagattgccaaacaaaaagtttcctccttccttgataacgggatatcatattgcaattatatgaaattctcagtaacagcccctactggataaagagactctagaggatagagactgtgccttgttcctcttgatgggcccagtgcttcaccttgtgtctggcaagcagaagatgcttcacatatacattcacacatggcgggctggcaggatgggtgggagaagggatgagtggatgagaggaaccacagttgagagttctgttttactaacttcatgttgcaatccttcagcaccagagggaaatttggctttacttgagtcatacagtgtttaatttttttttttctctgagacagggtctccctctgttgcccaggctggaatgcagtggagtgattatggctcactgcagcctcgaactcctgggttgaagcaatcctcctgtcttagcctcctgagtagcagggactataggcgtgcaccaccatgccaggctgatttttaaaaattttccgtaaaggtgggggtctcgctatgttgcccaggctggtcttgaactcctggcctcaagagatcctcccatcttggccttccaaagttctgggattacaggtgtgaactactgcacctggccttaaaaagtattttgaactaattttcaatacttaaaacttaggagattttcaaaatacagttatattttcaacttttctttgaaaagtcgtagatgcccctgcaaccctggatctgtgttccacattacccatctgcttgagctgaggggcacctgttcccttaagcaaggacatgcctccattcctcagaataacagtgtctgcccacagcttcactcagttactcactttgtagcttttggtaaaggtaatgagtggcctctcttcactgcagaattctcctaattcagtattcttggctaacagaagtattagtgttcctaatcatgttctggatatatccaaatgaacctagtaggcagctactgatagctgtttggatttctctcattagacactggagctgcatacttctgtggcatgttagaagtgaaacacggggcagaggggaaaaattgtttgagttaatggggtagtcaccattttcccacacgatataactccattggaaaaattgggaatttctacctgaggtccaccagtgttaagcctatcttgttctgtggcagttctgtatttgctttttttttaactaattggaaaataaataagaacaggatctggacaaagagagaccttgcaaagcatagtgcattcccctgccttcaggttggttcatgcctaatcagaaactgttcttgtcttcactcagaagccacagggacacttcagctccaatccctgcccaattattatctgcaagaaaaaaataggagtcttattagctttatattcataatttaacatgtccctttcttcccctccaatggtactttcccacaagtgagttttattgatatttgagtaaagataaacttgcagagaccacaaggagaaatattcccaaatctcattgtaatgtctcttctttcccacagattaaaggttatacaaaacttaaaagaagcagcaattctattcgcttgttattggacttgaaactccctttgacctcggaaactgaagatgaggttgccatgggaactgctggtactgcaatcattcattttgtgccttgcaggtagagtgtcattttaaaactttttgatttagaaatgccactgtatttcacactaattcaaaagtgggccttcactttagacggcaatgataaaatcgcaagagtatatgctgctatgactagcatttgctgacactgttgaatataccttcctgatggtcttttagtgactcttttcatggtgttgtatccagagatagacaccgatgtttcacctgtctatctggtccttttagagtcgtttgagccattatttagtttgaaagttgttatttttgctcatcccagtgcccagttgcacagagatattgggcaataaaactgataatatagtctggagtgttgcctactttcatttcagtggatggacgtttatctggatagctctttcagtgtctttgttgataccactccatcttctgatactgactctctttttcatttcaatgtactacagtttagtaggaactagaaagcaaaacacaggaggtttttaccatatactcatggccaactactagaaaagggatttggaaagttcaaacatggctgggcgcagtggctcacaccattaatcccagcactttgggaggctgaggtgggtggatcacccgaggtcagaagttcagaccagcctgagtaacatggcgaaagctcatctctactaaaaatacaaaattagccgggtgcagtggtgcatgcctgtaatcccagctactcggggagctgaggcaggagaattgcttgaacccagaaggcgaaggttgcagtgagccgagatcgcgccattgcactccagcctgggcaacagagtgaggctcggtctcaaaaaaataaaaaaagaaaagaaaagaaaacttcacacatactctctattgctttctccattttctggaagatatgagtctagcagttgacatacatcattcaagtgctggtgcatcagaagtccagcatgcagcgggaattggtttgcagcttgggctgctgtgtatcattccacgcccctttgaaattagtctagttgacttgttttgttattcagagtgtcaagtccaagagggacacctgaatatatttgcatttttacaacatgaagcaaaaatgacttttggatcaccattactttgatgtatgcattcactcaaataatgttactgagtaccgtgtcacaagccagccctgtactgggatctgggaatataatcctgatcaaaacagacatgctactgctctcttagagctctattaactgagtgctgtaacttctgacaacttgttgtagtagattatttgcaattgctataaaatcaaaaataataatggtagtactgacatgtatagatcactcattctatgctaggcaatatgctaagcacgtggtatcctttatccaatttctttcttccacgacccttaagaagtaagcatttatcatttatttcactgtattaactatgaatattaatattatgactgaagcatcaggaagttaagaaactcacccaaattcacaaagccagtaagtggtcgagctaagatgtaaaccgaagccgactatagtcttgcctgttcatagcgtatggtcttttagttgtcttgaggatttggcaagtttatggttgcaaatttagttctgagatttttgttttcattcttcctatgtttttctaaatgtaaaccctcatttacttatacatcttttaatagtctaccttcatgtttcaaacttcttgccttagttgagttcacgtcttccccgctgcatgattgtgaacatcttggcatccctcttagtgatattatttatttcccccatctggtcagagccttcatcttcctcccagcagtatgcccaggctctaatacctcagttgtttttctctgggaccttgaccctcctaagggattcgactgacactttagagttttaacttctcataatgactctggtataaacgtactctttaagccataaagcagtgaattgatttctcatatttggctacagcataatgtttatttaacccaatgtgctaagtaaatatcaagatatgaaagggttaaaaatcaagaaagccactactctcttcagtagtgttttgaaaaacttgggggaattctcacctaaggtgtgtgtgtaactgtatctattttattcacttagctttttatagagaatcagtgtattgattgtttttgtgaggcttttttgtgacctgttttacacggcattaatattctcttaccatatgccttcttcagtgtaggaaagtcaagctttaattaatgtttttgttttcttgctatttgtcttgatttcattaatttacatagcactccactcgctgaattttgattttttaaactgctttaggccaggcatggtgtctcatgcctgtaaccccaacagtttgggaggccgaggtgggtggataacctgaggtcaggagttagagaccagcctgaccaacatgaagaagccccgtctctactaaaaatgtaaaattagcaaggcatggtggtgtatgcctgtaatcccagctacttgggaggctaaggcaggagaatcgcctgaacctgggaggcggaggttgcggtgagccgagatcacgccactgcactccagcctgggcaacaagagtgaaactccatctcaccaaaaacgaaaaacaaaaacaaaacaaaaaactgctcattcttttccttttgtgtatcatccataacttttctatacatcttcaggctgaggtttcttggtgagtttttggtaagggatatgtttacagctgttatgtttaccataattagtgactctcacatatgccttttcctgatctttttcttccccaagtaagacaggatccaaatatacaagcaggctcatcctgcaagggatgcaactgataagatctgttaattatttgagggcatttattagtactttatggtacaatgggaatgttctttttcgccagatgactcagtgtctggcaataattttcaaataaaccaaaactattgatgccagtaatctaaaagttcagccacaatgaaaattggcttcattattcttcttcttcaccaatttaaactcaagatcataaaaccctgctacctaaaaaagcaaggaagctaacaaatgagtaaaatgttcttacagaagtaaaagtgtacagtgcaacagggaatgttagtgactatggaaaactagaaaacaacatgccccactaaaatattaatctgtgcccggctctactcctttgtgacaagtctcccagtctttttttttcaatctacaaactcctaattctctaggatttccataatgttaatgaataaaatttaaattggttttaaaagtaaaaataaagggcctgtataaagcaaaccaaaatggtctgcaggctagatgcagttcctagtccaccactttgtgacactttatttcaaatgtttgctttacaataaactattagtatattttaaaataggtagaagagaagaagtctaatatttctaccataaagataaacaaacatttaaggttctggatatcccaattatacagatttgatcttttcaaattatatgaatatgttaaattatcatatgtatccccaaaatatgtacatctattgtataaaaataaaaagtaattaaaaaaaataaggccaggcacagtggctcatgcctgtaatcccagcactttgggaggcaaagcgggcggaccacttaaggccaggagttcaacagcagtgtggccaacatggcgaaacccagtctctactaaaatacaaaaagtagctgggcatggtggtgcacgtctataatgtcagctgctcgggaggctgaggcatgagaatcacttgaacccggaaggcagaggttgcagtgagccgagatcgtactactgcactccagcctgggtgacagagccagactcaggaaggaaggaaggcaaggaagaaagaaatgataccgcatacacttagaccttagggcttttatactaactttcttttgtcaagaatgctcttgccttaaatgtccccaggacccaccgtctaaccttctttaaatctgtgctcaaatgtcacctaattggtgaggcttttcctgaacacagtaaatacattaaaatggcaatatttattttgaccaatatcttctatgctttttattgcttgatttctcctcaaagctctcatcaatatctgaataatgatatattttgctttcttcttcttcttttttttttttttttttttttttttttgtgagagagagtctggctctgctgcccaggctggagtgcaggggtgtgatctcggctcactgcaagctccacctatcgggtccacaccattctcctgcatcagcctcccgagtaagtcttccaagtagctgggactacaggcacatgccaccatgcctggctaatttttttgtatttttagtagagacggggtttcaccatgttagccaggatggtctcgatctcctgaccttgtgatctgcccacctcggcctcccagagtgctggaattacaggcgtgagccaccacgcccagccgctttcttctttttatacaaaataactttccctactagactgtaaggtttatttgggtagatatttctgtccttttagttcactgctgtattcccagcatccagaaaatgtctggcacatagtgcaattcaataaatatttttcaaatgaatgaatgctgcagcctggccagtcatgagagaaagagactagatctccagtttcaagctgtgctatagaccccgggtgctttgtagtcaccctgataccaactctatggactagcaatactatgatgctaatccatacatgtttttcaaaagtcgatgtaaatatctaaagtattaaaattggtctgtgtgccttgaagtctatatcttggtgcaacactgcctctcccatttcttattttattttatttttgttactgtttttttcttttttttttttttgagatggagtcttgctctgtcttccaggctgaagtgcagtggcacgatcttggctcactgcaacctccatctcccaggttcaagcgattctactgcctcagtctcctgaggatctgggattacaggtgcctaccaccacgcccagctagtttttgtatttctagtagagacggggttttgccatgtgggccaggctggtctcgaactcttaacctcaaatgatccacgtgccttgccttcccaaagtgctgggattataggcatgagccaccacaccaggtcacgcctcgcccatttctgactttaactatagctggggtagaactgttcccctgttgtatttttctgcctcaagtctttatctgagtcacaagcaaggagaactatgggaagttaaccccgtccttaggggcagccttcagctaagagggcatgagaatcagtagataaatgcctctgtctcctgtcctttgggaagtcaattctcaggcatatttaacatactttcttaggggttcaaggctggattgagtctcagtttcccacaataactccttctacttttttcttctttacttctgcttcttggtatcacctcctaaataaactaaactgcttggaagtcctgctcttagcctctacttttaggggagtccaaaccagctaatagcagagaggcagcttagttttggtcatgtcagtaattagaaagaaagcaggtgggaaaaaacagctttaacagagatgattggagagttgactgtgtatgtattaatagatctatatatgtatgtgtatgcatgtgtttgcataatacatgctcacaaaccactgtgtagttatatctataaatattatctgggtcctgcaattagggagttttactctttttagtatttgcttgttttattattaaccagatgttgagcaagtcattgtacctaagattcagcttatacttctgtacaatgaaggagttgaacagatggttttagagtcctgttcaattccagtaatttacaattctatctgtacacatggtttgagaggaagatatgtatgccgatagggttagagctcagcctggaattctattcaactaatatgaaatttcacataggtcatatgctttaccatgtgctattgattctgttcacattggcagcatttgaaagaaagaagaaaatggctgctccatatgtttacgtgcagcaagaggcgtgaagacatttaaaactctctgtgaatgagcgcagaaatttatgcttgatacattctcagttgatcttggtttcaaggaggctaaatttattcccatctctgtggtgcagtttaccaacttcagcaattatctctttctgagaaagtgcatcctctccaaatgcaagcatttgttgatttgctcacaaaatctatgtcgttattatatctgcatctgggggcatgtagtggagaaagatcctgtataattcacaggagacatattctgaaatgggtgaatgttcacaaaaagtggagcaaggaagacccctggattgaatcatcaatcacaggatgtagcttgaatctatgatagacaaaaatatatacaaacctgcaatgagaacacatacaaagaatgctcattggtcttcagaaggcttttgaggctcaggaagtctcatcactaagactgaagtaggctgtctaaagtttgggcttattctagttctgagagcaaaaatacacaaaagaggaattcccagtatttgttaatgttgatgaaaggactccatgagcaccatttttctatctactcagaatatttcattaaagctcatgaccaacccagaaggatcctcccttttatccccaccaggatggagagcacacagtagttcatttcaaggcttgacctcactgcacagcaaggtataatatttcaattcccaagattctcacattttcccccagaataaacagagacacaggcaacagtcaaataattcacaattctacccatgtattaaacctagtactactctgttcttgcacaagtaacaaatattcaattaagaccaaaagagagctgagtgttagttttcatttagttactgcaaagcatagtcctgtattttattgtttctctttgtaagaaaatgacttgccggtgtatttacaatcatgctgaccgaagccaaagcctgggtttcctgtttgctctacgctctctcataactatggccataaaatgaagcccatgtggtagaaagacttagtcaagaagacagctaataactagattaaaaagcagtgactccattgatgaaagttaagaaaaaaaataggggaagtatacttagaaaataataaatagcaaatgcaaaacttcttttcaacataaatttaagtatttaagtccatagtgggaaaatgttaatcagtaatgaagatgttgaggtaaatagaggaactggcagcgattttatatccccataggcatggacatgtagtagcaagcacacaacccaaaagttattagaaatgttcaatttaagacctctcctgaagtaaaattgtgaatgggtccattagatatgctcagccatgctggatgtcttaactataagtaaaactcccttactgatagagtctagggcgtattgtatctagaaaaaaatggaagaactcttttgaatgaaacaatttaggaagacaggaaaaaaccagacaagtgaaaatccaattatgtgtacctaacgtcaacctgtgtgatcattctctgtttaaatgtgggatcagtgatgctgcctcaaagcttgaggatgacgggagcaggaacagtctggcagttggtatcatgccaaaaacaccagctggagacactgcagagctggcggttgagaatatggactccgaaattacatagataggtctgccacttatgagttgtgtgataaaggtacatcatctccctaggtcatgggtttctttttttttttatctgtaaaacaggcaaaataactgtatttacttctttaggctatctgtgaggattgagaacgtgcatatattctttgcacttagtgcagcatctgatactttgcaaacccactgattaatgagctattattcattgagtaatttaacatatgttgaaggttccaaatgtgggaactatgtttaacttagaactaagctatttaatatatatgttaaatgttaaatatatgttaatgtttatgttaaatgttaaatagcttagtttgaaggtaaacatagttcctgttatggcaatgataatgattatggtgacagtgatgttgacgatgatgttgccatattagtttcttagaacattagtttctggccattcttcagtggttgaaggtgttagaacagggtttacagcacatctggaccttatctatacaatggtgttacaataataaatacctatgcagaacaaatacctaaattggttaagcttgtatgtgtgtgtgtgtgtgtgtgtgtatgtacatacatgtgtatgtacatgtaattgtgggtagagcactcaggaaggtctgtcttagtacaggactaagtaacagttgttattaatatcagttaatatcaggactaagtatcagttgctattaatatcatcattagcagcagcaacaacagcaaaccagtggtgttggtgacagccagaacatttagggtctgtctcctggcagcaaggcagctaggacaagtgccaattagagacatccatctgggggcctggcagtggcagagagctgaggaggtgtctataatggtacttccagtagtttatcaagttgtaagaggatagggttccaaacagagtaggatccagtggttcaaaatgataactttgtaaatgcattttgcaacaacaactaacataaagaaaatagcacgtaaaagcccttaatgttactgtactggaatatgctgcagcacagactccattttccaccataatcttccattcctctccacacgcaaactccccttgctgattttaatcagatatttcacctgaatgaagaaactttgttggatgatgtagccccacttaataatgaccttaattcatttagtccttgtgagtctataaagtatttgcttaacagtctatttaagaaggctgttaggaattagagacaactgcaataataatagtaagagtaaaaagttattgggcatttatatgccagatacagcacctcagttttgtatgcactatcacccttaaactcaaaacaaccctctgggagaggtattatcctaagttcatagataaggggttacatgacctaccaataaaaccagagcttgtagaagtccaaggcagcatttaaatttaggtctgcccaggtccaaagcctgggcttttaattgtcatgctatgatgataactattgaaattgagtacctgtcttcataaagcttaccatcttgtaaaatactctgaaccaatggttaccaaaatttagttcatgaaccagcagcatcattgtcatctggcaacttattagaaatggggattttggggctcaggcccagacttacagaattggaatctctgcaggtggggttgtccttgttttaacaaggcctccaagggttgtgtttctcaatcttaccagcctgggtttctactccaagaagacaaggagagaggggaattatttctcagctaaagctataccttaagtactctgaggtcagaccagaatccatttagaatccactggtctgacctcagagactttaatatataaggggattctgatgcttaagaaaggttgagaaccacattaagcactcttgaaagacaagtaaggcagaaattatcagtatcccaattttacatatgagaatctgagagcacactaacatggtcaaggttatatggctgacataaacaaagctggactctagatgtattagtcatggttgactcaaagaataaggtaaatactgttttaacacatcccctttaagacaccttcatagaggagagaatgtcagagtcttgtatttagaaaaaacagtgaagaccagttttttttctcttgtaaagtttttccagagaacctgcaaattgcattgaccaaaacagaagtaatttgcacacaaatgttcataacagtattattcataatagccaaaaagtgggaacaatccaaatgtctatcaattgataaataagtaaaaaatgtggtagtcccatacagtggaatattattcagccataaaaaggaaggaagtactgatactacaacatggacaaactttgaagataccgtgctaagtgaatgaagccagagacaaaggccacatattgtatgattccatttatggactgtccagaatagacaaagccatagggacagaaagtagaatagtattttcccagagccaaggagtgagggaggataaggaacgactgctgttggatatgtgatgtctttttaggctgatgaaaatattctggcattagaaagcggtgatggtcactcaacctcgtgagtacactaaaaatcacttaactgtacattttaaaaggctgaattgtatgatgtgtgaattatatctccataaaaacaattaaatattctgaggagaaaaaaagtactactgtctcctgagagacactgtctgctgtcaggaagttagagttgctcagagccaaattccctgatacatgataaacagaattacataattatagtcctatcccagttctctcattttacacacaagtacactgatttgtccaaagtcccacagataatgagtggcataatcagattccaagtttcccaaactgtaatcccaatctgtcttccactcctccgttatggagcttccctgttgtgtgttttatagtcatggaaggtggctgggattgggggcggcggggaggggcagtcactggtctcttaccaccaccctgcccagcaacaatgtgcaacttctttaattagagaaaaggaataaagcacaaaccttcctcagagagtgaactctctcatgttaattcacctgaggtgtgatattggattccaccccaagagcagggagacttaagacttctagagggcaaaggagggcagcctctgtggtgtgagagtgatcttgaagatgcaggataggcagtcacttcacctattttcaattttgtcctagattggcatccctaggaagcaggatatcttttcatttcctgccaaacctcctggtggccaaaattaaaaatccatattgagtcagtaattaaacttccccctacctgagggttatgtcccagaccaatgctttaaaaagagttctgatacaaaaaaaaaaaaaagcagtttaatggagaaagactatctgaagaaagaatgatgtcaaatagatttaaaacgtatgaatgcagcaatatatatgttgcttgggctgcataagtaaaaagagacaaaaatcaatctaaactccccagtttcaactatattgtttccacatgcgtgacatctataccagaaaaaaactaacaaaactagaaatgcattcctcttggaatggaaacaaatgtcaaaacaaacaactcaggataaacttgagctagagaagaaagctttgctctactcttttctaaggagctttgaagatctggccatggttgacataacaactcattgcagcagatatgttacttcaacagggagcatttcacagattgtcaaagttgtcttctcatcccatccaacctatcttgggggagggtgagaaaaccgaagagcaaaaagattaattcatttgcccaagttcacatggctaagtgctttcagatactgggaatgtttgatttacttgaatcaaaatagtgagaatgtcttcctgaattatacttgataatggttttctagttacattataacatgtctaagctctatataaatgaaaatgaattttattaagagtgttttagtatttgattggctttgtcaaaagatttcagatagtggttttggggaacttggtgaatgcccatgcagtttttgatacagtggcaaagaatatttgtagaagatatgactttttaaactctagaacttataattcctcagaaaatatttacgcattctttatttattaatttatgaatgaaataactgttcattcatttaataacaatttgttaaacacctatattattgggtactgatagatgttgggtgtaccgagatatctgtgatttagtccatgaatttaaggagtttataatcttgtgggctgacacaatttgtttcaaactctgttctgccagatttaagtgagaaatccaggcaaaatacaatgtttctgtcaatgaaccatattgttacagtatcagaagctactgccttggtacagcccacagtggataagatcatggtcctggggctgagaaaaatctgggttcaaaacctacctgtaattatagttgctcagtgtatgagcttgaggaaattgcttaattctctgagaaaacatttaaaatagcccagtaactgccctatagtcagcacttaataataatgtctattgtagtcatttattaataacaaaaggccatggcctcctctctttatcgctgagctccaatgcaagtaaaacacttccatctactttaccttcaatgggtcctaacttgcatagtaggaataaagaaaaaaggaaaattgtgggagtaggagggaaagagagaatgccatgagccgcatgccttctggcctttctgtcattttccaggtatctattcttccaagtaggagggtcaaaagtgattgtgtttagttttgttgtaaagttgaccaagaacggaataggtctgccgggcacagtggctcgtgcctgtaattccagcactttgtgaggctgaggcgggcggatcacctgaggccaggagatcgagaacagcctgaccaacatggcgaaaccccatctctactaaaaatacaaaaattagcaaggcatgatggcaggtgcttgtagtcccagctcctcaggaggctgagaatcacttgaattcaggaggtggaggttgcagtgagctgagatcgtgccactgtactccagcctggatgacaaaagcaaaactccgtctcaaaaaaaaaaaaaaaaaaaaaaaagaataaaaaaaagggaacaggtcacaatttccctcactatcaaataattgtttgcatttaaggggaaggaggaagaaaacaagcttgatgcctattttgtttaattatattattctcagggtaaaactgtatcttgttctctacagtggtaggtaggtaggtagatacgaagtaggaaggtaggtaggtaggtaggtagatagatagatagatagatagatagacagaaaaaaatgtatataagcacttttttctgtatttttaccaagtctgttgggcaatctgttgatatttgaactagataattttaaaaacagaggaaaatactacatcactcacctaatattttgtcattaactacaaataattattattttaactgatgtttttacatcaaaacatgacttaaaagtcctaagcaaatttttcactactgatgatggtaatgattaaaaagtcaggaaacaacaggtgctggagaggatgtggagaaatagaaacacttttacactgttggtgggactgtaaactagttcaaccattgtggaagtcagagtggcgattcctcagggatctagaactagaaataccatttgacccagccatccccttactgggcatatacccaagggattataaatcatgctgctataaagacacatgcacacgtatgtttattgcggcactattcacaatagcaaagacttggaaccaacccaaatgtccatcagtgatagactggattaagaaaacgtggcacatgtacaccatggaatactatgcagccataaaaaatgatgagttcatgtcctttgtagggacatggatgaagctggaaaccatcattctgagcaaactatcgcatggacaaaaaaccaaacactgcatgttcttactcataggtgggagttgaacaatgagaacacatggacacaggaaggggaacatcacacaccggggcctgttgtggggtggggggaggggtagggatagcattaggagatacacctaatgttaaatgacacgttaatgggtgcagcacaccaacatggcacacgtatacatatgtaacaaacctgcacattgtgcacacgtaccctaaaacttaaagtataataaaaaaaaaaaagaaaagtaacccaatacagagggggagaaaaaaaaaaaagctaatgaggctagctaggctcagtgtttctaggaatgatgtaactagaaccatgtgacttttatcatatatttcatcaatgaagataataaatgcttaaacaagataattaccatcctccttcctctctgttaaatgcttcaaatacattatataatttatactgggctcagagtagccctaatatggctaatattggtacctctgtacctctgtattatagatggggcaactaaattgggtcaagtaagtggctgaaggtcacacaagcatggcctccccagaaccagatacttcccacctactttgtcctagtcaaccttagcttccgaccttactgtgttccttccagtgcaacattctccatttttgttgttgttgtttgttgttgttgttttgtttgttcatttgtttgtttttgagacggagtcttgctcttattgcccaggctggggtaaaatggcacaatatcggctcactgcaacttctgcctcccacgttcaagcgattctcctgcctcagcctccagaggagctgggatgacaggcacccaccaccacacctggctagtttttgtatttttagtagagatgggatttcaccatgttggccaggcttgtctcgaacccctgatctcgtgatctgcccgcctcagcctcccaaagtgctgggattacaggcgtgagccaccgcctgcacccctccaccaacactcttctttttatagtccctgtgcggaaactcaaaccatttgtcccctgtcccagtgcctcttcagtctagtccttcaatagcttcctcctcagttactgatttgctacatgactatggagacaaccagattaaactgtgtagatgtcatttcccattgctttatttctgtaactgcaaccacactgtagtgatttctgctttccctcaagaagacaactgtcctccaacacccaacattttatctctgaattgttaccttatttactctgcagcccctacagtagcagtcattatgtctcctcctgacctactctggtatgttctttctcccttcctccttccctcctttgatttttcagtctaattatatcttagcttagaatataaacttttagctaatgaaattttcttcaaacatgccttcaaaccccagctgttcatttccctctgagttaaaatgagtaaagttttgattatgtttgtttaaaattcactaggctaatatatccatatattgaatgtattccatatacattatcttctgtacttctttaaaggcaaatgtgaaattctctaacaaagtctttcctataaaaaaatatgacacaccactctcaggggaattatgataattcaaagaacaaaccaaaccaaattaaactcacatcttttctgagcaaaagagtaaataataaaaatgcagaagtattgtttgttagggtcaacagcttttgctagaacctgatgtgatattctgtatagaattttgttgggaagttatgaagtactgataagacaggcaaatattatttgcacacaaatgatccttgcaaaataaaaattttcaagtggagataaattcttccttatcctctttagttcttcagcagggttcttggataccgtctttgggaatgctcttctctccaatgttgtgatatttacatgaaaactttggttttaatgtaatatttatctaactagatataaccagacttgaaggtgattctctagatttcttgtacctcccttatgatttcagctatgcgctcgattcagttgaatttaagaagattatcaatggcatttcataattgtttatggatttcatattatttaaacttgctctccagttcagtaaataaattttagaggaaatcaatattatgaattttttttcagttattagaaattgcttttgagttttagtctttttctttctttcttttttttcttggtgtaattgtaatagaaacccaaggagtctagaactgtacttgctaccttctggttttgtgactttgatcaaatcactctgcctctcaggatttcagactctgcacaagtaaagagtgagatggagcacaagtgagctttctaggtcagcgtttcccaaaattttatcatctatttttgtccaatctctacgctccctgtattattattctctttaattttttattaattatgttttttttttacttgaaggaactttatcacagcagtatcacttgttataagtaaaaagtagccgtaaagataaagacaacagaaacaaatgtattaaagcctggcacgtcctcagaagactctgctcctgagccttgatagttcaccacaagtataagactgtcatgtgtcagagagattttaaagacatgctggcaccaagtgagactttatttttagtttaatcagaagaactcaaagagaattaagtgaaagaggagtgacttattcttaagtgagttaggttttgtttgtttgtttgtttgttttttgagacagagcctcgcactattgtctgggctggagtgcagtggtgtgatctcggctcactgcaacctctgcctcccaggttcaagctattctcctgcctcagcctccaagtagctgggattataggctctcaccaccatgcccaactaattttttgtacttttagtagagacggggttttactatgttggccagactggtcttgaatgcttgacctcgtgatccactcgcctcggcctcccaaagtgctaggattacaggtgtgagccaccacgcctggccatgagttagtacttttttagtgcctgatctctgtacaatccaaaaattatctcccattccagtgttgtgcatcttgcgtttttagaaatgctaatgtaaagaggaagcatcttccagctctaaaaaaaaaaaaaaaaaaaaaagtggatgctgtaatgccccaatgtaataatatattctggcaacagtgatccagatgaatcatatttttgtgtgtgatcagtttttctttctacatttttcatataggtaaatatttgttgtgtattttaactcatgtactaggtaaaagttgatgtaaatcaatttggggctaagatgtaataatactgttgcctttatggtttaatttaatgatgttgaaaagctttctaagtagtaaaactatagctcattttattccttgcctctccccatccataatagcatgcaatgagtgacataaaggggccagattaacccctgaactgcagccctagaacagcgatggcctggcatagaaagttattgtgactggagatcctttaatcaccagagtattttgacagagtgctgagtagttgcggcattagtagtaggagatttgacacagaaaccattcttaaagtcttggggagcccagttggctcttaaaaacacaacttggaattcctttagtttcagtgccttatttttacctttctttgaagtgcctttttgttcactgatctgttaaaagtgcaatcttgtttctgtttttagccatccattgctattaccataataagcccagtgtttcaaacatgtgtgtcttagagtataattcttccttactcaagactactcaagccattccttccctcccacaaagatgatatctgaattgtgcaggcattggaagaatgcaagtgtcattctcaacttttttttcacctccataaaataaaaacaaacatttatgacctcatgcaaactttttgggtcaggaatttgggagcagcttagctggatggttctgattcaggaaattatactccagtatcagctggggctgcggttgctgaaggtttgactgcggctagagcacccactttcaagttggctcagtcacatatgtgactggcaggctcatgccaggtgttgacggtaggcctctcttctgtaccgcatggagctccctatggctgcttgagtgtcctcgtgacatggcctgtggcttccctcagcagatgatccagagagaaagcaagaggaagccaagtggcttgttgcagaagtcacagttgtcagttccataatattcaatttattataagcgagtcattattttctgccccacactcaagggaagggaaataagttctatattttagaagggggagtgtcaaagaatatttggacgtaatttcaaaccaccacaatctgttcctctcctttgctttcatactgggacaaactgtcgtcagttcttacctacacaacataatacgattctggttggtcttccctcatcttcactgctcttccactcttgtgcatttctaatccattctccatggagaatcccaagtgatcatttgaaaacacaaatctatcatatcacctttcttctttttttgttgttttgttttgagacagggtctcgctctgtcgcccaggctggagtgcagtggcacgatcttggctcactgtaacctacgcctcctgggttcaagcaattctcatgcctcagcctccccagtagctgggattacagacacatgccatcacgtccagctaatttttgtattttgtgtagagacggggtttcaccatgttggccaggctggtctcaaactcctaacctcaagtgatctgcctgcctcgcacttttctgcttgggtggcttactgttacacataggataaaatttagagatcttttcaaggcatataatgtcttacatgagttggttcctgctgccttctctaacctcatctcatacaactccctctgagctcactagaaattctaatcttcttttccattactaaatcatgtcaaccgcttcctaactcagggccttcatacctgcgatttactttctcttttgaatggtctttccccttcctccttgcctgtctatgcctagctttatactgtagatttctgcttaaatacctctccagcagaaaaacttttcctgataaaacttagatagcactgtatcatttgttttctcttttattaaaaaaaaaagctgtattgaagtataattgacatgcaataaactataaaaattaaggtatacactttgatacattttgtcataggcatataactgtgaaatcatcatcaatattcgaaataatgcatcactccaggaggtccctttgtggaggatccttgttattttccaagttggaaacagtgcctagaccatcacaatatttcttacaatttataattgctaattgctttcatctcagtttgtagtaactcgcttgtgcatctcaccatctagactggagctccatttgaagagaaaatgtgtctgtagagttcattgctacatctccatgatcacattgtccagatgttcaataaatttttgaatatatgaataattgtttgtattataagctgataaagtcccttaaagaaatacaagtcaagtgcttagatacttttgatgtagtctgccctttgaagaactagtagatttgtgacttttttttttttttttttttttttttttttgagacggagtctcgctctgtcgcccaggctggagtgcagtggcgggatctcggctcactgcaagctccgcctcccgggttcacgccattctccggcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccgatttgtgactttttaaaattgtagccttctgaaactaagcgaaaaaaaatatgaggtgaatttttgaaaggcctaaacgaagaaaaatgagatcccaacttgtctctcatgtaagggaggtaaagaaaagtaagtgttgaatgccaggtgtagtagtctgctctttatttgagtcgagactaagaagcaatcattgaaaggtttttatttttttatttatttttattttttgaggcagggtctcgttctgtgagaccaggctggagtaagtagtgcaatcatagctcactgaaacctcaaactcctgggctcaaggcatccccctccctcagcctccctagtatgctgggactacaggtgcatgccaacacacctggctagttttttaaaattttttgtacagatgaggtttcactttgtttcccaggcgcatctcaaaatcctggcctcgagcagtcctccctccccagcctctgaaagtgttggacttagaggcatgagccactgtgcccggccttcattaaaggttttcagcttggccctgactttttattgtcttggctttgcctcaggacaattaatatggcactgatacataagaaaacatatgaatatcttcgagacctgtactttacctatctgcatgatttatatcattgcaaataaggaagaaaagttaggaaaagacaaatataattcaaagtgtttaagttttctgaaactagagggttggtgatatggtttggttctgtgtccccacccaaatctcatcttgtagctcccataattcccacatgttgtgggacgtaccgggtaagagatgattgaatcatggggatgggtctttcccattgctgttctcatgatagtgaatgggtctcatgagatctgatggttttaaaaacgggagtttctctgcacaaactctctctttttgcctgccaacatccatgtaagacagaactttgtgcctcctttccttccgccatgattgtgaggcctccccagacacgtagaactgtaagtccattaaacctctctcttttgtaaattgccccatcttgggcatgtcttcatcagcagtgtgaaaactgacaaatacagttagtttaaccactctctggagtgttctattcatgggttggtaacaaataaaccatttataatttaaagttttcacagccttagaaatgctcacatagatgttaggaaatagttttggtatacaacaaaacagaacctttgtgcacatttatttttgtattatattgtactgagggtttctaatcaggtgaagagaaaagcagtgtcagaatgggaagtctgaatttgaattggatatgtttaagcaaattgtctctttaccagccctacctaatttgagaatacataacacccactcagctctccctgaactcacatgttggattttcccaactaattttaatacacacagataaaaagaccagatatttggtctatacattttctgaatgtatggaaacatctatttatgtaacaagcataatattatagctgaaattgaaatcatttttgtattttggtggttgttgactggctaatagctaataagtcaatgtcaggatagcgaaatcccacatgtattcaaatatttaactccaataaataacatttgttcattcagcacctactaaatgaatctacctctgttaaccttcgcaattatcggataggtagatacattgagattatccctgcttagtagatgagaaaactggtggttaggtataattttcccatggtaatgccacttaccagtagcagagttgcaattgaaacttggatttgtggcctctgaaatgatcaagtaatagttattgatttttaagttcatgtaatgacaactatttgtttgatcttggaatcaggactgagtatttttgatagaaaggaataagtcatattttggatgggcagatgaagatcttataagaatgttactgccacagcttatacctaaacatgttgaaaatattttagggaagagaatgtatatgttgatggatttgtgttagctgcttttggattcaatgattaaagccagttttgccttatagctaaaagtatctgataaaaaactaatcacttgtcataaagaagagaagtggaggctatgtcatcattaccatcaccatctgaagtcgtcaaatatattgcatttcctgtgatgtcccagttagttccaagcagttatatttatataaaatcatatatttcagtaaatattggagctttgtaagaataacattattttaacataaataggtgttttcagacagtctcattatttgtgtattccaaatatgtagtaccttgaagaccttgacttatttgagaacagcatgaaaatttgcctgcctgaaaatctattggcgtatattcaagatacgttttacaagcaggagattattttgggagcataattcatcactttgcttacatagttgttggctctttgtctggcatttgattggagagctacattttcttggagtaatgttgaacacaattttggagaaactggtttttttttgacaatttgaaatgttactgattaagatcccttgaggccaattctatacacaaagtacatatttatccattgattccatgaaaacataaaaattctttccatttagtaaatagataatttggtacaggattatttgccctggagtaactggttaaccagggtataataaaatggatcttttttttttttttttttttgagacagagtcttgctttgtcagccaggctgtagtgcagtggcacgatctcggctcactgcaacctccctctcccaggctcaagcaattctcctgcctcagcctcccgagtagctgggtttacaggcatgtgccaccacacccggctaatatttatgttttttttggtagagacggggtttcaccatgttggccaggctggtcttgaactcctgacctcagaatcggccagccttggcctcccaaagtgctgggattacaggcatgagccaccgcactggccaacaaaatggatcttgaagagttccttcacattagatcagaagaaatgtgtatgtgtgtttgtttgtgtgtgtgtgtctgtacctcctgtaattgtcatgtgtatatgtttgcatttagagtagttttttcttattcattttcaaaaataaataatcaattttgcattatttcttgcctctgatcccaatctattagtggaaagaagtgagattcaaccataattggaaaagtcatcaccttttaaaagaagtaacattggtcacattagtcccaattccatctcacattgggtatgtgaccagccttgaaccaggtgaaatatagaaatacagaacttcagatatgatccaagctatacattagtgggaacagtacatcccttgatagtgacactattctatttgaatgtcttaaggttccattgacatgcttttattagctccttcaaaatgttggctaatattacacaattgactgagtatttctgatgcatcctttctgttaataccaaatgccaataaatttcatggtaaaataatttgatattggcattttaaagatattatccttagttttcatgccagttagatcccatctgagtctgcatgtattaatagacttcaggaaaaattccacaatgtcacatatcatgcatggcctagagaaaaggctttattgggaaatttacatatgtcaagatttaacaatgagaagagaagccaggggtcctataatcttccacatcccacctaaaggtgtggcaggacctggctgccttgatcctgcagtgtggctctgtgttcctagcaagggtccgttctcttcagtagcctaccttgtcaatgaaggataagtggaccccttggctccaggcccccagagaccctcaggcgctgtgggatactaaagtatcccttgtgtggaggtggaagcccctggttgtatgataagctgagcttgggtgtagcccctcctactgggagaaggtaggatatccctggctgtagttgtcatattgtccagagttcagagagtgagtatccagcgttattttgagtcagtcctgctcatttaaacttacaacagtagatctgcatgatccccaaacacgcaggtataaaaattttctcaaagttgaccacctgttagacaatctcatcatttagtggaaacctcactgtaatcgccatgaggattatgtatcatcatctgttgtatgtgggtggcattgcactagtactggataaaacaagtgaagctatcatggtttttctcttctaagagtttattagatgacatcattctcaaagtctaaattttgtgaataaaaaataacactatagcatgtgcctttacatgaaggtttaattaaaagcaatgaatgaatacatatgcttcaacattaatctcactgaatatatttttaagaatcctgcagtttgactgtagataggatgaaatgttaaaaatagaccctaaacccaccttgatttatgtatttacttggagagaaacaggtgagggaagcatattgaatcataacctaattcctacaaacattgatttacacacaaattaatttactaaacaaattatagtttatacatttatacattaagcatatttatttaatttaaacatactagtaaaatggacatcggttgtcctccaaattctttgtgttttcatttagataaagatgataatgttgacaataatctgaagcttaataacagaaatagcaatcatgtgttgaatatttattctggtggtagtaaggaatcaatccatatatatttacacatctataaccatacacatatgcatacatatataatagataatatatatttatgcacattttgtattttttttcatttaatctgcacaccatcccttaggagtaacttatttttatgaatgcttctcagataaatggagaattagggaagtgcaatcatttgcccctgttcactctactagtggaagcaggatttgaatctaggcgatttgactctaaaggtccatgctctttatcactattcaatactgcagatgtaaattataaggccattctatccatgtaattttaatacaataaatgctatgtgctgagtgttttttaaagattaaaatttgaatctgcagtaaactggctacttatcttattgtcaaccacatctttttcggtactgtgtccaggacacagttagatattaagtaaaaacatccctggtcattttttttttaaatttgagtttctctggcttctgcacatagcccatataaactcagaaacccgttatttggagatttcactgaatgaaataccataagctttgtagtgggaaggggttgtaagaccaggtcacccaaacttagtttgcaaatgctgcagcagctactcttagcagccactgtcctttccatagcatttccaaggcacctgcattcttttgcagctactactacccaccacacctcttccttagcagttccatagccaagatttcagagattgttatgaaaatcacattgaggccagtacttcgttagaaatttaataaggactacaacattgggttgcaaaggaaggggtaatgcctcttctactaccatttgtagtttgtcctctaggttcagcattaacaatttttatgaagtattaggagctttcaagggcctttggcagggagcaccttatgcctcaatgaaggagccttaagcaaagttaataaaaatgcgaaagtattgtgtcttgacataaggctcctgagtcgtaatgttgataatcttcagcatagagctctagcaacatgatgcatctggtgtctgtaacccagctgttccccaggaaaggtgcagaattgagaatcatcagcctgaaggcatgcataaaagacagcacctgagaagtggtgctgtgtgcctatggaagagcccagtcagaggagtacagacttcaactgaaccatcccccagtatagagatgcgcacacgtcaggggagcataaatgagaaaactggactttctcaagcctgaggtgttggataatgacctgacagcgttctcactagtcccataaaacagcctatgtttgttcccatctaatcatgtgactagaatgtaggagagtacttctaaaagtaaacacatttgaacaatctgtatgtaggaggaagaaagtactgtattaaaattgtcagtttttcttcttatttttccttacctaatgaactttttggcatctatcagtttctaaccaggcagctgctgaaatttttattcatgccttggtttcctcaagaattgatttttgtaattcttttttgcagccttcccttaccgggctattttgaggttgcagcacactgtgaattcagcaggtgcttcaagcctggcagcatcttattgcctttcttccgacttcctttagtgacctccagtatcaaacatgattgctcttccaattttaatttctacttgctgtggtaccgaacaacctcgttagtcctatcactgagcccagttggcaatgttgggaggtctgagtagttccacactccgtaaattgcagtggtattagcaagtacaattgcatactcttaatcatcttgcccttattatatgagaagtttctggtgtattttaagggagaaaatgctttagagagtaaagagggaaaaaatcaaagcaaactctccctctcaatattctaatcacgaaggactggaattttcaagaaccaatttcaatttgatgcttcaatatagaattgaatttagggtgtatgtgagtgagtgtgtatttttgcacacattcacatatatatatttttaatatggtacttgaactgcaataaagccagtactctttccttgattttatgtagaccacttttacatcataattcaaaaatataaggaaacttatgtagccgtaatagaaattcagtagaattagaaagtaaaagcaacaaaatataaagggctgccagcagctaagccttcgcaaatcagttcagttagttgatgtgtttatttgtgcatgtagagccattgtatttgtacaaatgtccctccaacatatatacatgaaaggggtattaaagatccactctcttggttttgtggctgaacaaattgcctcaagctcttactaatggtaataacttttcctatttaaagggcattttcaaatgggagaagattgttattttttacttttttaaaaataatttctgatctaaggaaaataagctaacatctatacaacagaatacattattggtaataactgacatatgttgagtattgtgtgctcaacatatatagcttggtgtataccttatagatcattaaaaatagcaacactgtaggtaagactgggaaaatgtatgttgtttatttcagagattagcgtgtatccacatgtagggaccatggagtgtagagttggaggttcggccaaagccctcctgggccactccttggcaatgttactagttgtaggttccattctatcacagttttaaggatgatgaaactgaggcttatagaatttaagtgatttctcaagatcatagagctggtaaatggtgaagaaagaatttaaaactagtatatctgaatccagaatctgagctgttgactaacatgtagcattgccatctccaatccttggggatttatttttcacagggcctaaatgtgtggaccttttattctgatgcctttttcttcattctttttgtttgcttaaactaaaccttcttttgaactataaaggtgatggtgagtaacaagtcccatgtgtgattttattgtacacagtcagaagacagaagacactcagacagcccatctgctcagagtgtggcttacatcagtttctgtattacggctatcttttgtagaatgatttgtagcctttatcaaacttctcttggttaaaagtttgtaatggcagagaatccctagctaaacagtcagagaaagtaattccttagaggaaattacatcagcattattcattattgcattagagagtgtatttttgtcaattctctagcagagatcaagttcctgagggaattagatggagaaagaagcattgggtatgaattggatgaggttttatgttgcctgaagcttgagttacttattagcaagagtccaaaacatcttctttattgaagtttggagctatctgttcctcaagtgacaaaaatgttcaaccttcatttggggattctaccccaactctattttggtttatggaattcttctttttttttttttttttttttttttttgccaaaacattctttatttggtcaataaagggcagaagttttggattcttaaacattcagtatttttttaaatttagtccagggtttattcaaataccattttgccccaaactactctctcctctctttctggggctctaattatatgattgttagaccttggagggcagcttagattttttttatactttaagttctagggtacatgtgtacaacctgcaggtttgttacatttgtatacacacgccatgttgtgtgctgcacccattaactcgtcatttacattaggtatgtctcctaatactgttccttcccctcccgcaccccacaacaggccccggtgtgtgatgtcccccttcctgtgtccaagtgttctcattgttcaattcccacctatgagtgagaacatgcggtgtttggttttctgtccttgtgatagtttgctcagaatgatggtttccagcttcatccatgtccctgcaaaggacatgaactcatcattttctatggctgcatagtattccatggtgtctatgtgccacattttcttaatccagtgtatcattgatggacatttgggttgattccaagtctttgctattgtgaatagtgccacaataaacatacgtgtgcatgtgtctttatagcagcatgatttatagtcctttgggtatatacccagtaatgggatggctgggtcaaacggtatttctagttctagatccttgaggaatctccacactgtcttccacaatggttgaactagtttacagtcccaccaacagtgtaaaagtgttcctatttctccacatcctctccagcacctgtcgtttcctggctttttaatgatccccattctaactggtgtgagatggtatctcattgtggttttgatttgcatttctctgatggccagtgatgatgagcattttttcatgtgtctgttggctgcataaatgtcttcttttgagaagtgtctgttcatattcattgcccactttttgatggggttgttgtattttttcttgtaaatttgtttgagttctttgtagattctggatattagccctttgtcagatgagtagattgcaaaaattttctcccattctgtaggttgcctgttcactctgatggtagtttcttttgttgtgcagaagctctttagtttaattagatcccatttgtctattttggcttttgttgccattgcttttggtgttttagtcataaagtccttgcccatgcctatgttctgaatggtattgcctaggttttcttctagcatttttatggttttaggcctaaaatttaagtcgttaatccatcttgaattaatttttgtataaggtgtaaggaagggatccagtttcagctttctacatatgggtagccagttttctcagaacctttattaaatagggaatcctttcctcattccttgtttttgtcaggtttgtcaaagatcggatggttatagatgtgtggtattatttctgagggctctgttctgttctgttccattggtctatatctctgttttggtaccagtaccatgctgttttggttactgtagccttgaagtatagtttgaagtcaggtagcgtgatgcctcccgctttgttcttttggcttaggattgccttggcaatgcgggctctattttggttccatctgaactttaaagtagttttttccaattctgtgaagaaagtcagcatcatcctgataccaaagcctggcagagacacaacaaaaaaagagaattttagaccaaaatccctgatgaacattgatgcaaaaattctcaataaaatactggcaaactgaatccagcagcacatcaaaaagcttatccaccaagatcaagttggcttcatccctgggatgcaaggctgattcaacatacgcaaatcaataaacgtaatccatcatataaacagaaccaatgacaaaaaccacatgattatctcagtagatgcagaaaaggccttcaacaaaattcaacagctcttcatactgaaaactctcaataaactaggtattgatggaacgtatctcaaaataataagagctatttatgacaaacccacagccaatatcatactaagtgggcaaaaactggaagcattccctttgaaaactggcacaagacagggatgccctctctcaccactcctattcaacatagggttgaaagttctggccagggcaatcaggcaggagaaagaaataaagggtattcaattaggaaaagatgtagtcaaattgtccctgtttgcagatgacatgattgtatatttagaaaaccccatcatctcagccccaaatctctttaagctgatgaagaacttcagcaaaatctcaggatacaacatgaatgtgcaaaaatcacaagcattcctatacaccaataacagacagagagccaaatcatcagtgaactcccattcacaattgcttcaaagagaataaaatacctaggaatccaacttacaagggatgtgaaggacctcttcaaggagaactacaaaacactgctcaacaaaataaaagaggacacaaacaactggaagaacattccatgctcatggataggaagaatcaatatcatgaaaatggccatactgtccaaggtaatttatagattcaatgtcatccccatcaagctaccaatggtttatggaattcttatgtatagatagcttcagttcacccaaggattacaagcattatatggtaataatacatgaagaagcagagaaaactaaagtacaggttgtcttccttagcaagtacaacctttgcccactgaatgtgctttcttaagtctcagctttgagaaaaagcaaggcttaagtaaggggggttccagtgagcagacattagagtatttcctattgtattaaggcaactgaatgaactgtttgaaagtttaactctcagggtggcttaggtggcttagtaaatacaattatgagaggaaatgttttcttcacttacttgactgtaatttgttgttaagatatattttgaaattgttgagtattttctcatttttctgtgcctctcaattttctgccaaaaaaaaaaatttctgagaattttgtttttttcatttaggatggaacaaagttgctgttactctatgtgattagggaatgatgttttaggtgaattaaataataaatgatttttcccatatgccaaacatggaagactaatgagatttgaaatgcagcgtatttcttgatattgaaaatatacaacatgaaattttttctttgattcagaaggtactttaggatgtcctagtgtgggaaaatcattagaaattgtcagtctcttgtaacattatggaagtcctggtttatcggtatttttctgtggtgagagaagcaggtaatcaaatctttacagaaacaaaatcctacagaaaataatgctggcagtctgctgattaaagtgtctgaataaaatggattaggtaaataaaaagaatgagcatataagtagaagaaattgtagtttctaaatattaaattcagaaagttttgattaatgacttacgtttcatgtcatatggcttaaagattttttgccttatttcttatccttgaaaacaaagtgaagtgcatatgagagctccggtggaataaaaacagcccgttatgggctggtctattacttcttcaacaaagctctatctactgtcatggggcagcttagtatgacagaaagaaaacagatgtgtgtttcagctcttctgcttaatagctttgtgaatcagccaggatatacaacatggtgtagttgtgctacagtagaaaccctttctgaaatttccctggcacagtactgcacgtgtgtatgtttgactcacagcgcattatccaaggtgaattggcagagggcctctgcccacgggtcattcagagacctgggctgatggaggctttctgtcaatgcctgcttcaaacaccgtggagagtggaaagggaaatgtggcaaatcatacaggctcttaacatttctacttggaagtgagatgtaatttctgtcacatttcatctgccagagtaagacacatagtcaaagaaaaagaaagtaggattctaccatatatccagagagatatcactaatgacaaccacaccatgtgtttttgtataaatctcttagtgtgtctgagcttcattatgctaatctgttattttttttaaaaagtggaggatttccctgacttgatgcctcttcctgtgaccctcctctgaacttttgtgtatcctagtcaccagaggaaagatgttttttcatttattcaacaaataattttcagctccttctatgtaaggtaccagctaggctttggagacgttgcagaaaacaaaaataggtaaggctgatctcccagttcttatgttcagttggattgacaatcagcaaaatagatacatatctatgtaatatttcagttggtaaaaagtgctaagaggaagaataaagtagggcagatttgttccaaggaaaacttaagaaaaggggggaaataatatatgaatatcagtaggtgaaggtttctagatgatagaagaggaaatgcagagccctaagcaggattctgctaggcattttttaaactactttattgaggtatgatttacatataaaaagctgtacatatttaagagatacaacttgatgtgtctagagataagaatacacccatgaaaccatcatcacaatcaatgccataaacttattcatcacctccataagttttctcctgcccccttgttgttgtttttattttgttttgatttcctcttatagtaagagccaataaaggaaatataagatctaccctcttagtacctttttaagtaaatagtacagtattgttaatcatatgctctatattgtaggggagatctccagaacttattaatattttgcataactgttctgctaggctttttaaacatttatttagagacagaatcttactctgtcacccaggctagagttcagtagtgtcatcatagttcacggcagcctcgaactgctgagctcaagtgatccttccacctcagctcccaagtgctaggactccaggcatgcacaccatgcctgtctaatattttattttcttagggacaagttcttgctatgttgacaaggctggttttgaactcctggtctaaagtgttcccgagttgggattacaggcgtgagccaccatgcccagctctctgctaaacattttgagaagcagagagaccaggatatctggagtgcagtgagtgaagacagtgttaggaggtgggagaaggggatcagagagaaggcaacatggcagatcatgcagggagagccctgtagcaaggtaaagactttggattttttttctggatgagctgggaagcattgtagggttttagacaaaggggtgtcttgatatgatctaaattttctctggcttctctgtggagaataatctatagggtggcagtgatggaagcaggagcacagctgggcagctattgcagcaatcgatgtaagataaggatggcttagacccaagtggtggaggtagagattgggagacatgccagattctggatgcattttgaaggtggagctatcagatttgtgaatggattgaatgagagatatgagtttaccacagtaattattactatatagatgccattcatttataccacaaaaccaaccgatgtcctgtcaggtgctagtgctgttccacagttggggttacagcagttgggttttcatgatgttgaattctagttaaagaagacaaatgataaataattcgaataataattttaatatgataatagtcagtagttagtgctagaaagaaaatttaatcaaggggatgtgaatgatgtaagtggctacgttggacaggcaaggccttggggagctaaggcctgagccaagaggactgagatgtgaagtgatgggggaagcaggggaatttggtggggcagcactcgaggcagacacacatgtagtgcaaggatcctaaggcttgggtaataggggaagatatgtcattgcagtttaaatatcgaatggggggacaaagtggttctgtattgatagggaggtcagtatggaccagatcacactgggcttggcaggacagggaagaattttagattgtcgtgattccttggcaataagaagttattgtaaggtttcaaacggagaacaatataacctaatttgtctttgacacagggaggagaacaacatacactggggcctgtggtagggcaggggtcgagggggagggagagcatcaggaaaaacagctaacgcatgctcagcttaatactcaggtgataggttgataggtgcagcaaaccattatggcacacgtttacctatgtaacaaacctgcacatcctgcacatgtatcccggaacttaaaataaaataaaataactcacagtgactgatgggcggataatgggttttaagaggactttgacaacgaaaccatttaggaagctattgtgttatgactaattccatatgcttttcttatctgaacacaataagttgacattagttttgtttttaaagtgaaataaatatttgcccctccatgctcctacccctgcttgttcgtcagcattcttagggaatgaaatgatccacagaagacttcccaaatagctgtggtttccctctttaaggtctgtgtctttaaaagcacatggtccatttcagtgaaagtttttctgaatatttaatacatacttaccatttaaatggaagatagtaagtaaaacctaaacttttcctttgcctcatggcagtattggtgttggttaaaaatgataacttcagagacttcagatctccagacccatgagctttacagatgctagctctattctttttccattggctcctgactgtgatgtccttgtgcttcgcttccacagtctcctatccccaggtttttaggacacatttaatcttctttcttgatacagtgctacttctcttgttgagtatttgatggacttggtgactgttacattcttccaaggccacctttttttggcatctggttcaaactatgtctgtttttgctagaaactgtcacgtgaataaaggaaagagtagaaattattgtagtcatattgcagagcaatttgaacattccactgaagttgaatatgtgctacctacaatctagccatgataattctagatatatgccctagaaaagcaggtgcatatacacaagaagacacattactgggatgttcaccaaggcatcatttgtaatagcaaaatggtagaagcaacctaactgtccatacaaaaagggaatgaataaataatctgtttattcatataatggaatattgcataataaagtaactgaattaaagctgtatgtatcaataagaataactgcaaaaatgtaaagtgaaaataaaaaatttcaaaaggatataaaaacgtaatgtaatgctctttatatatattttagaaataccaaaataatacgtgtgtatatacatatgcatccacacacacacacacataactaatggctaatacagtataaaaacatggtaatgatacataaacctttcagaaaacttcagtgaataaaagcaggtagaagagagaaaggaggacctagttgaatctgccctttttaaatgctatgttaaaaaatagatacatatgtttttaaccaatctgtacaatgttcttacctattatgtctggcttttgattatgtagggtatcaatttatgattttttccatacgatagaaatatttaataatttaaaatatcatataataaaaacgtgtcttttatagttcttcctacaagctgtatttgatcacttctgtggttttatgggtggctcataacatctagtcacatcataaaattcttttttccttgtgattggctgaatcatctttaggcgtgatgcttaatttagacgtttaggttaactcttcaataaaatcacaggaatttattgtaagatctaaccaagggactgaaataaattgaatgtagtgaaatttgaggcattgtttcagccaccttaaagaccacatgatctactgatacagttgttaaatccactcagataaacatgtgtgctccaagttggagaaatctgaggcagagaaaaagaattgtcccaggtgcccaagtccacttatatgaacaacttgaattgaacactgttaatattaggctcttttgccaggagtggtggcatgcacctgcagccccagctactcaggaggctgaggtggggggatcactagagcccaggaatttgaagctgcagtgaactatgattattccactgcactacagcctgggcaacatagtgagacgctgtctgtttaaaaaagaaagaaagaaagaaaagaaaccctaggctcttcttcccctctccccagacaaagtctgctgcagtgatctcggcttactacaacctctgcctcatgggttctcatgggtttaagcaattttcctgcctcagcttcctgagtagctggtattacaggcacgtgccaccatgcctggctaattttttctctttttagtagacatggggtttcaccgtgttggccaggctgatctcgaactcctgacctcgtgatccaccagcctcggcctggcctcccagagtcctggaattacaggcatgagcaactgcactttgccccttggctctttttaaaaaatgcatttgtttgagagtaatgaatagaaaaggaagttgtggcatgaactatctgattcttcttttcttccactactgggagatttcataggccaaatattctctctagtcaggggcatgcctgatgatgcttacagtctataaagagtctggtcttgttctcctttcatcttctctggagaaaggataatcaacaacagaaattttttaaaaaccctcatactttagacaagtcacattcagccactctgtggaaacactgatttttctacgaggctttcttagagaataaatattaacacatatgcttcatgggctgatagatattgctgtggtttcaatgtgtcctctacagaatttgtgttgaaatgtaatctgcattgtggagatattaagcagtgtggccttttggaaagttattaagtcacgaaggatgtgccctcgtgaatggattagcaccttagaaaggggctggaggaaactagcttaggaccctttgcccttctgccttcaccatgtgaggacacggtattcaaggtgccaccttggaagcagtgagtgggccctcaccagacctcaaatttgccggcacctttatcctggacttcccagcctccataactgtgagaaataaattcatgttgtttataaattacccagcttcaggtattttgttatagcagcaggaatggactaagagagatttaatatggaatcccaaacaatgaaacaactatttgtacttctaaaatataggtagttctcaaaagcattatgttcagtaggatagctctctaacttatctctaaagttaattaaacattatggctgaaaaatgagttttagtttcctctctttgaacttctataaagaaaatatacctttgagacttgaaaagttcagtgctatgaaacgtctttctagggtagtttgggtagcaccaaagtcacctataattaaaattacatattttccattttaaaaattccattttataattttcaaataaattttttactatcaataaagaggtattttttgatttgtgcaactttatatgtagcacttggtttcattaaacaaatgtcattgatttcattagcataaaactttattttcttcaccttaattttgaatacaattaccaaataaaagtagcttttatctttgtccctttgaggttagagatgatatcttcttgatttctctgtctctcccgagcacagtgcccgcacatggtaggtaattaactgtctgttgactggttaaattatctgtattacaagtaaatacaaaatgccaggttttacaaaacactcattccatattgtctatcactcccactctattttatttttcaccatagtataagttaagatattattaaaatattattaagatcatctggggaagtttgctcacttccattcttgaaattattataatctcctcttaagaaaaaactcaaaatgtgtaagagcatctctgatagcttggttcttatttgtataatgggataattttatttcttcagttgccatcctgcaaacactttttctaagtctttaggaacctctgtttttaaattgcttttgcttcatgtgataaactttaagcccgtggccttctaaaatgattcagtcagtcagttctgacatctcttcatctcttcttggtagcaccctcgccatttctgcaacgatttccactgagtcgcatttcagcctgtgtagaaactcatgatgacgtgttgttttataatactttacactttgtgtattttgccattatgggggtgggttaatgtgttataaatgtacaaatgcttgttatcacagtaaattctaggtagagaacagaccatggaaatgttgttttaatttgtgttagtttgagaaaattaataggtatctcatatgacttataccagaaaatttaaaaactataaacatacagccaagcaagaaggcagtcattatgagtattttcagagtgtattgtctgagaatacggtggcgttttccattgctaaaaagaaatgcacagttttccactagtaacttgggagaaatattttttcaggtatacaatgcagggagttacttgacctaaaatgggtacttaaatttcattgattgtttaaagataagtaaataattttcccttttttgccagagttgttttcatgtaacgatacgatacatcttataacaatacttccattataacatgctttatatgtattatctcatttgattcaggtgatgactattttcaatagatattgttgctgtctccattttacagatgttataggcaaagttaaaggtgtgtaggcaagttacattgattcaaagtgatggacttcaaactctttgcctctattttgttggaacattcattaaatcatatagcacctgctatgagtggagactttcaactcataaagaccagaacatttaggggacaaaagtactcacagcacctggaaccaaaaaaaaaaaaaaagaaagaaagaaagaaacaaaaacaaaaaacctgttaaaaatttcttcatcacagacaagactctttcaagggtactgatagccatgggacagagggaaggacaggtaaagttgatgggccaaggagagtaacatcaccttcctcagcctaagctgcaggattataggaaaagctaagtagcctctgggtgatagtacctgcttgggagagccgttgtgtgaattcactttgtaaggtccaaaaataaatgtgacttagatacgttcacaccattcctctctttcccttttttcctgggttacctgctgtccacctagctttgactattgccaatacccaatgcatggatggaatacagtgagaaggaacctgcaagtgtcaatggaggcagaggcagagaacaaggatgagaacaacaaattttaaagaagctgtcttgaacatttggggaatagaggttggtgaggagactagccaagatgttttgtctctctgttgtataacagagtgccctgtggcatctcttatacaggtggctatacagtttttaatcacttttttaaatgttggatgagtatttcttttgattgcaataaacttatggtgagacacactactaggtggcccagttttattcaggatatgtaggagatggagctttataaagctgcattcatgaagattcttacaaaatattctcaggtggtaacattttaatgggtaaaaataacacatgctttcaaagaaaaatctattattcaacttaatataaccagttttatatatacatataatacacacacacacacacacacacacacacacacaacagacagagatactttttgacttacaatagggttacatcccgataaacccatcataagttaaaaatatagtaagtcaaaaattacatttaatacagctaacgaaaccaaatgtcgcagcttagcccagcctaacttaaacataatgagatcacttacctagcctacattggtcaaaatcatctaacataaagcctattttataataaagtgctgaatacctcatgtagtttattgaatactgtacagaaacttaaaaacaaaatggttgtatgggtatttgaagtacaatttttactgaatgtgtattgttttgggggaccgtgtgtatatgtgtgtgtgcgtgtgaattggaacacacacagttgcttttgcagcagttttgaagtcaagatacaacatatactaatattggtttcacaaggtaaaggccattattatccctatgagaattcagtgaggaagatactgcttttagctgggtagaatgaggtagataaaatatattttgattatttgaattaggagtttcatgtgatgagctgcattgctacatatcttatttcttactctttaaagaaaccaacaagcttttcatgtctctattacagaataaaatagagtaatatgccaacatatagacatttaattttgtcaaatccaactatgcaaacttaaaatgaaaggaaataggaggatataacaacttaaatggcatcagcaatttctcacactgtttcaccccaagagtgttagccttagtgaccttgagacagaagaagtgaatcacttagtagatctctttttattgtatgcatgactagaggaagcatcttagggtgctgcatgtgagcattacgtttaagaacacaatgttgtagaagtatttcttgtatattgtgccaggggctttgtctgcttatcagtggtgcaatacatcatccgtgaactaagattttcattttatcattaatttgttatcctgagagtggcaacttagttttacttaagatagcttccgtagttctaagcacacgtggagactccctgttcagaagaaaaagttctatgtatttccatgtattttattaatgatgacaccttttcctaaagtctcccccaaactgtttcttctcgcttctcattagcaaaaatgacatcacatagccaaaccaattcctggcaaggaaaaggatatcatgatcatttacttagatcaaccgtgattcaaccatagacttgtggatgggcccatcttctatgatgcacatggccagtcaaaggaaaattttggattccagtagaaaaaaaagaaaagagattaaatattgattaggtaggtgctgcaacatatttgttcattaatgtactgtaaagcactatttgtatttcacatttatacattcatattactttataagatggtatacataagaccatgtatattgtactttttgggcaatataaggactttttgtagggctaattttgactccaatttttgctatatgatcagagttacactataattcatgaaaaagacaagactcaactctaatatcaatattagccttagtttaccagttatcactatcggatgtgtcataagcatttgtttttaaggttgaatagagaacctgattgggtgctataaaagtctgatcaacagcttaaatgtttgtttgtttgtctttcttaaggaaaatgagcattgagtttctttctgttccacattgaataaacctcaccaaatctatccctacattcagatactcagtccacaaatactgagtaccttctatgtgctgaccgctgttctaaccctcgtggatacagtaatgaatgagatagataaagtactttttctcaaagagctaacattctattgtgagaaaaaaatagaataatcagagaagtcaacaaaaacaaaaaatgtgagatactgaagagcatgtgagagcaggccagtgggtaactactttaggggtcaaggaagtcctctctgaggaagcagagtttaagctgaaatctaaatgacaacaaggagccaccatggaaacaccagagaagtatattctaagcattggaaatagctggtgcaaagaccctcaggtgggaataagcttgaaatgtagccagcaagtgggaaagaggaagatgaggtcagagaggtatgcgaagactagatcatgtgagattatgtaatccaggtgaaaaggattgattttgattctgaatataatggcaagtcattggaaagatccacttgatcaaaaagtgacaaggtaacatactggataaggtatgggaacagtatcatagggaaacaattgaagtacaattaggctgttgtccaggtgagaggtgacggtggggaagaccaaactggtgtagtgaaatgtacaaaaattgaacagattcaggatgtttgggagataggatggaagaagtgaggaaatgagagaacggggtgaactttcaaacttctggcttgagctacggcatagacgatgaatttttctcagagatgtgtaggaagcaggttcactgaggagagagagcaggcagaattgagagttttgttttggtcctattgaaatagagatgcctgtcagacatccttgtagagatgccagataaacagttggatacatcagcctggagttccaggaagagactaggcctggagataagagatttggtagtcatctgcatataaaaaagcaaagaagtgcccacacagttattttaattaattccacagagccttctaaagtataatttggagaactgaaaattgatgggtacttatttattgaaacatttgtcttgaaaatttgttgacaacacaattgctgagaaattaattgatagttcatgacaagcagtgacggctcatttcctcaaagtttccctaaaagacaaagaaagttttatgttattagctttggcttgctttgaaaatttgtttttgcacatcactgttttgggttagcaataaaattctctgcatttgcttcataaatcaaacaaggacacaattgttaaatagtctgtatcatattaattaggctctgaaacaaagcaagcattacagccatttataacagggtattgcataagttgctaatcaatgagaaaagcaactaattaacaagcaaccagtcagcattttgagcagaagttggtgactttcagcttaattaaaccttgcaggtgtcagtgatgatatgaaagaatctttaatctgtttgtgttgaaattcccccagatcattttcacatctgtacatgtttaaagcccctatctactttcatgtaggtaaagggaattcagtgtcttaaaacagttcacatttttaaaagccctattcttaattaaatcattaagatttctcctggattaagacagtggaatgaagttcatcatctatttcactctaaaaaaaaacttagagggctaagcagctttattgaagtataatttatataccctaaagtatacttgtttcaagggtaaaatttaatgattttaagtaaatgtatagagttgtgcaattatttccagagtataattagaataaaggaaattttaaagtttggacaaatttatccatgaggtatcaaaattagcttgtgagggaggctagatatacctagcctttaggaatgacctataaaagcactgatacatctttccttctagccttcaagtgtttccaaccatctgctacagctaccatcaaaaacaggattctaaatgggatgaatcaaggattaagagtaatctattccttaaataacttttaaaataccataaattcctctttaattacagtagattatttggcaaaattaagaatactagttcctcaggctgccttttttttttttttaacattaagttccggtatacatgtgcagaatgtgcagtttgttacataggtatatgtgtgccatggtgccttgctgcacctattgatccgtcatctagctgccctcccctaaccccccatccccccaacaggcccagtgtgtgttgttcccctccctgtgtccatgtgttctcattgttcaactcccacttatgagtgagaacatgcggtatttggttttctgttcttgtgtcagtttgctgaggatgatgctttccagcttcatccatgatctcattcctttttatggctgcatagtattccatggtgtatatgtaccacattttctttttccagtctatcattgttggtcattcaggttagtttcatgtctttgctgttgtgaatagtgctgaaataaacatacatgtgcatatgtctttatagtagaatgatttatattcctttgggtatatacccagtaatgggattgctgggtcaaatggcatttctagttctagatccttgaggaatcgccacactgtcttccacaatggttgaactcatttacatttccaccaacagtataaaagcattcctatttctccatagtgtcaccagcgtctattgtttcttgactttttaataatcgccattctgactgtcatgagatggtctaagaaaaaagaacaaagctggaggcatcgtgctccctgacttcgaactatactacaaagctacagtaacgaaaacagcatggtactggtagcaaaacagacatatagaccaatggaacagaacagagacctcagaaataacacccaacatctacaaccatttgatcttcaacaaacctgacaaaaacaagcaatggggaaaggatctcctattcaataaatggtgctgggaaaactggctagccatacgcagaaaactgaaactgaaccccctccttacaccttatacgaaaattaactcaagcgggattaaaggcttaagtgtaaaaaccaacaccatcaaagccctggaagaaaacctgggcaataccattcaggacacgggcacgggcaaagacttcatgacgtcaatgccaaaagcaacggcaacaaaagccaaaattgacaaatgggatctaattaaactaaagagcttctgcacagcaaaataaactatcatcagagtgaataggcaacctacagaacgggagaaaatttttgcaatctacccatgtgacaaaggcctaatattcagcatctacaaggaacttgaacaaattttcaagaaaaaaacaaccccatcaaaaagtgagcaaaggatatgaacagacacttctcaaaagaagacatttatgtagccaagaaacatatgaaaaacagctcaacatcactgatctttagagaaatgcctttttttttttttttttttgagacagagtcttgcactgttgcccaggctggagtgcagtgacatgatcttggctcactgcaacctccacctcccgggttcaagtgattctcctgcctcagcctcccaagtagctgggaatacaggcacacgccaccatgaccagctaatttttttgtacttttagtacagacggagtttcacaatgttggccatgatggtcttgatctcttgacctagtgatccgcctgtctcggcctcccaaagtgctgggattacaggtgtgagccactggtggccgacccgagaaatgccctttttttaaagggatagttctctcatggctaattcaaggaatacaaggattctttcataatgataatgtctctatttcttctcggttataatctctgtgcaagatgatgtcattttcaaaaagttggaaatgggcaaacacttgtatttgagatttaaataagtatgcatataaaaaatatttgtcatattgagcacattacaacaattatttcaaatttccaagagatggatgatgatttgttgaatggaagtagaaaatattaagtaaaatagcagccatcactttctatgtgccagaaactgttctgagcactatccacacacttaggacagtgccttaaacactgtatatgtagtagttagaacagatacatgtttacatgtaatatgggataggtatgggggaatggataatgcttagaaccatcctggcacatagaaagtgatggaaaacagttcttagaacaattcctgggacatagaaagtgttgtaaaaattaaatgtgggtatatatatatatggaatatgcatgtatatgtgtataaataatatatgtatatgtgtgtatgtatgtataatatgtgtatatgtgtaaatatgtgtgtatgtacatatatcattatacattttgtatatatacatgtttacgtatacacatattattacaaatgtttgctctatataaataagctatatgtgggatatccaatataaatatctattctataagattgttgtaaaaagtaaatgagcatccatatgtacatgtatatacacactcacttcatttttacaacaacctatgaaataggtatattgatcctattccagaaactaagaaactgagcctcataaattaaacagtttgctcaaggtgccccaaatagtagcacagcggggataattaacacagaaagtcaggctctggagtcattgctcttatttaatcagtatctcctactggaaattttgattatcaatattgttcatatcatatggcttcaattgtttatcattagtgaaacctacaatgtttcattcagtgttccaatctaataaaacaatttgtgtctgctctgacatacttctcttaaaaatgtcaggtattttcagacacattggcaacctggtattgtggaaggagtggtaagtttggaatctggagacttaggttagaagtgatagatcttccaacagatcattgcagagactgggaaattatttaggctcaccaaaccagttatctgtaaaatacaggatatgttccttgaccttatacctctctgttgtgccttcataataatgagacagtagcacttatattgcctgagagtttctgtttacttgagtatctcttcataaagtgtaagttctttaagggcagggaccctgtcttttttactttgtgtcttcagcatcctttaggctactccctgtcgtctcagaagcacatactaaataagtgcagaagcaaactataaaagaagagaaaatatcatgattcccaaaacagttttcatcaggatcaaatgtaaatgaaattccgttcctgggctcttgctaccagctggcctatgactaaaacaccaggctggtgctgcttctagtagcaatagacattgactgaaaggcatggaagcaacctagaaattgcattgattgtaaatattttcaaatgaatatcttgaagaatggattcaaaacattccattatccatctatggggaaaatatttgcagcctctgtatatacctttattttgtgtttctgttatctcttagagtctttcaaaattgttgatcagagacaaagggtggctgttggatcataattgtaaaatgatggacatcagaagaactatttagttaagtaatgagagaaggagcaagtcctgtagaacttagttctaggatatcacacagcacatttcaggactcttctttaaatccttaaggagaggtcttttcatttgcctgacgaagaacatgagggaacaagcactttttccttgaaatgttttttgtactgatcagatctgctaataacgcaacatagacagactaccaggaatgcaactgcttatatcctctctgttcacaaaacattgcagtgcatttgttgtgccttcattttcctcatcagaactcagagctcatgactttaacccttttcagttttggaatcagttgtttctaagataggggctatgctttgtttctgtacctggtacttttttcccctggcataaatgaaaatatctcttcaaatatgtacccaagtagtagtaatatactctgtcccagtccctggagagctgtacaaactggaggtaagccagtcattcatttgattatattaagattcaatgtttaaaagcaggacaatgccataccatatgaaatcatattttacttctcacttactttagctcagttactttggtgatgcagaaagtggttttgaatttaagataggcattcaggctggaggcaggggctcacacctgtaatctcagcacttgaggaagctgaggtaggtggattgcctgagcacacgagttcaagaccagcctgggcaacacagcaaaaccctgtatctatgaaaatacaaaaaataagccaggcatggtggcatgtgcctgtagtcccagctacatgggaggctaaggtaggaggatcacctgagcccagcaggttgaggctgcagtcagccatgatcgtgccactgtgctccagcctggggaacagagggagaccctgtatccaaaaatatatatatatatttattaagggtccatagaaatctaggttatagaataggttatatcataaaatattagcctcataccttcattctactcataaaagacttagctgtataaaataaatattgccacaggttgagtttaatgctttctaattgcttggctttcagtgaagaatctctttacacaagaatgtccttgtgtgcggaataaatcggactttagaaaatctgaaaacctcatttacacagaaatatgcacatccctggactctatacagcccccctcctgtgtaattattcttcctttgacacaaagcactctaattccagaatgcctgtgttaaaaattaaagttggttaggtgtgatttttcctttcggatcctcttctggacattgaacaaaaggagactatacatttaaaagacacaaacctaaacatgaagtaagaaagacttgaaatttggctctagaaagtacatatttgaggctgagtaggttattttaactcaccaaatcttaatttcatcctttgtaaaatgaaatgatgaaaataatacttgccttataagcttgtctggaaagttgacttagacaggtcctgcaaaaatcttggcatgttcgtggacacatagaaagttctcagttaacgttaagcaccccctgttctcgcgtcttcctcctcaccttctcatcgctgatgtatatgaaagtataacatgcagcaagggaactagactgagtctgcctcaacacattctggaaggaagtattctgttctgcctatgctcctttccacaagttttattctaatcgtcagatgtgttctacttcatctgagtaattgtttgtgataacacctggagaggtcttaacttttgtatcttataaaaacaccaaacaccacatgttctcactcataagtgggagttgaacaatgagaacacatggtcacaggtcacagtaaggggaatgtcacacaccggggcctgtcggggggtggggggctagtggagggatagcattaggagaaatacctaatgtagatgaccggttgatgggtgcagcaaaccaccatggcacgtgtatacctatgtaacaaacctgcacgttctgcacatgtaccccagaacttaaagtataataaaaaaattaaaaataaaacaccaaaatattaagtggggagtgacttaatgaaccccatggaatgagaacgaaatacaatgtatatgcatttaacttgtacagttgtaagcagcatttttcagtgggctgtgatattaattccatttcacaaaagaatttgtgagactctcaagcaggtatggccaagagaatgatcctcattctgatttagcttctcagaagattgatgttctctctgggatcttttgtgtgtccagcatggtacttgcagcagaccattatgtgctgtcatgctgcttcttgatatccagactcggtgtgctctgcagaactgcagcctcgctacatgtttcagtgcaggaaattcacattaagggatccttttccagagagattgctcaggcaatttcagttccatctctgttttaaatgttggaaaacaccccctttctctcagtctacccttgctctgcatgcctatcttttgctttgctgtttctagattctgcgtttggttatgtatcctgtactcactatggcagtaggaggagatttaatatttattaccttttggtgggaagaataacttccagatgaaagtccagctgaaaacatagtctcctttggacaagaatataaagacttcagtctgccagagtagcattactagacacctggctgcaggaaatgtgatgttacttttttgacatctctgctcactgcaacttctgccacccgggttccagtgattctcgtgcctcaactccccaagcagttgggattacaagtgtgtgccaccacgcccagctaattttttgtatttttagtagagatgggttggacaggctggtctcgaactcctgacctcagcccacctcggcctcccagagcttgctgggattacaggtgtgagccaccacgctcagctggacaagcaagttttgaagcagaggagttgtctgcaaaatctggaatatgggggcagttatggagaaataataattagtactgttcattgaatgttttaatgtttgccagaccttttgagttcttcatatacattatcttagcctacctaaagcaaccatgtaaggatgtgtgttaatatatccatttacagatgaagtaatggaaactcagataagtagatatttcatgcaagatcacgcagctggtgtggaaaagctgagatctgagactggtgcactctgactcaaaagccagcactcttagggattagatttccttgtgtgaaaaataggtcatatgagaatgatggaagcatatagctacttttctttttcaccaaatactaattctgcatatacacataataaagtagtttttctgtagctatcaaggacttacctgaaaaggaaagggtgacatcagaaatccatgctgtgttgtgggggcatatttactctcaccttaataaatgctgcaaagcattatagaaaactacttccctgctcatggtaatatgacaaaatcctttcatcttcacgtttttcaaaagtgatattctggtgggcctgcaaatagtaaatattagcttcttgaaagatcctttatggagactaatttttttttttttcatttttattctcatggtttttttccctgattttctaccctcttgttttgcccattcatggtccatatatttttgtcattttaactcctcatcctgaagcacagcaatcatttctgagttttatggatcaccgcacagatattctggtggtaggcgattaatccttatccaaccacacagcagttttacctaggctttgggatgatatttagctgttactgtggagcttcctactggaatctagagaacagaggggcaggggaggtcagaggataggtaaacataaatcaggtttgtgcaaacaagcatgatgaatgctagttcccaaagtgctctgccttttgtcaaacttatatattaggagagagggttgtgtggcatgaatgatgaatcataaaactgctctctctggtgaaagggcaagcatagaaaccactgtagtaacacggtagcttggatgcatcatagggcttgggaatacagagtggaaaacagtaatatgtgtatcagcctgaatgaaacagtaaggagaacagagcagagtgtcccctgactaggaaatccagatcagtcaaaaggaagtgagtttggagaagcaaaacaagatacagtacgtcagggtttcttaaccaggcctcacacatagaaaaaaacaaaacaaaacaaaaaaaccctgtctgttcatttaccatttactgaaatttagctgtttcttcaattattaatgagataatcatggaattttgatcagctacagtggctttaccactaccagaagtaactgattgatttcttcatatatatctcaaaatattgtttatgccattcactactttgaaatttcagtagctattacattcaccactagaaacatatattttattacaaaatttaaaaatacttttaaaattgttcttcagtataaattgttgtctttgtaattctgtgtatgttattttatgcactagaaaatactatcctgaaaaagcattcataggtttcaccagtacactaaaagggtccaggaaagaaacaaaaagtgtgaactcttatggtcgatatgctgtttttaatgttaggtgagattcagctttttaagaatttaatttttagaaagcttgagagagaaaaatttctactttgatatattcagtacaatatattttgccacaagtcagcatctaccatgaataaaaattaatttggggactaatgccttaccttctacttgtcaaccttgcaacctgcctgtcaacatgagaccatggcaagcttttcagattaatcagtgctaattcagctcccatttcctttacttgtattatacagataaagtttgcaatgagattaagagtcttggctcttaattggaatttctgattctttttttttttttttttttttcgaggctgagtctcaccctgtctcccaggctggagtgcagagaagtgatctcggcacactgcaacctccgcctcccgggttcaagcaattcccttgcctcagcttccccaatagctgggactataggcgcatactaccactcccagctaatttttgtatttttttagtagagacaggatttcaccccattggccaggctggtctcgaactcctggcctcaatgatccacccacctcggcctcctagagtgctgggattacaggcatgagccactgggcctggcctctgattcttaattttagctgtactacttaattatatatgtgaaactagatatattattttatctccctaagcctcagtttactcataatgtgagtaataatagtagctaccttatagggatgtggtgaaggctaaatgcaataaagagaacttaaaacagtaaaaatacatagtaagagcttaatccataattgccagtattgttttcagtacatactgtaatcgtgcttaataagaattgtaacccactgccatcttcatcctccaaaaaggtagtgggtctctaaaaatccatgcacacctcccacaacgccacaagagcagacttctgggaccctggacatcttgggacctcttcataggatggcttgtatattctattctaaaactatttgcattaaatattaggtcaatatacaagaatacttacaaagtatacctaaggtataaagaataactatgtaacagatacttaatgacagtttaagccaattatcatttaccattagctctgaaatttccagaatgctcctctgtgataccagtctcttccctcccaagtgtaaccatgatcctgaaatttgtgtttattattccactacttttatggttttgccacatgtatctcccaatataaactttgagtgaatagagttacgttgaaacttgtgacttgcttctttcactcagcttaagttcctgagattcatccatgctgctataactagatctgtttatcttattttcacttttccatcattatttgtgaattggtattctataatttgctatccacttactattgatatcctctctttttttgctattatcattaatttctgctatgaatattgttaaatatgtctcctgctgcgcctgattctaacaagtagagttgactcatgaggtatttatatcctcagcttcacgagataacactaaattgtttttcaaacaatttttgttgttacatttgttctaccagtatcgaattgttcctgttctttcacattctggacaacacttgacagtgtcagacttttgcctgtttgacaatttgttgagtttgaaatgatatctcaatattttaatttgcaattagacgtctccttatttggagaagttctgtgtattctgggcactatcttttgccagttctcttgagttgcacacgtattctcccagttgcttgctggccttttcactcttatttggagtcctttgatagagcagaagctcttaatattaacatagttgagcccattaagttttttctttatgattgtactttgtgtcttctatcttaaaaatccacaatctaaggccgaggtgggcggatcatgaggtcaggagatcgagaccatcctggctaacacggtgaaaccccatctctactaaaaatacgaaaaaaaaattagccaggcgtggtggtgggcacctgtagtcccagctactcgggaggctgaggcaggagaatggcgggaacccaggaggtggagcttgcagtgagccgagatcgcgccaccgcactccagcctgggcgacagagcaagactctatctcaaaaaaaaaacaacaaaaaacaaacaaaatccacaatctatttttcatatgggtaaaaaggactaaataaaatccccttatatcatttaagagggaaaataattacccaagaggagaggaaagaattggattggcttggaagtggttatttttacattttttcatctgtagctacactgtgggtagaaaaatagaaaaattacttgtgataacccagattacttagcatctttagataataaaagtttactcttactgtggcattcacctctaatttaacttcatgagtctgttttcttagtcaactgtactagatgctagagatacaaaaattgttacgaggaggaagcaagcgtctaggcctccacatctggatagccattctcacatttaccacatcacagggatgccatgcaagggcagtacacagaagtttatctgtgtttcattttataatcttagtattttgtgtgtccatactcagtctgcccttggttcccactccccactttgctcttctttgtatataatttgatttgtgcctcatcttcttactagtctgaacatgttgttgaggtaggatatccaaccatcctggtttggctgaagttgggagacctcctgggatgcaggacttttagtgctgaaaccaagccccaggtacctgggacaaattggtcaccctactttgagggcaaggactatgtatgttgcatctttgcaccatgtacaactcattttacaatgtttacacatagacagtagtttttaaatggattttgcattaagttggaaggcactcagttctgacatggatccttccagtcattcttgcaagttatgtttattttctagcatctgatttcatgaagctgccatttttcttagacaagttgactcttttttcttgaatccactgaccttagggtagcagtaaactttgtttaccaacagggctctgtcatccacatgagggatgttgccattaagtgtctttttttttttttttttttttgagatggaatctcactctgtcgcccaggctggagtgtagtagcgcaatctcggctcactgcaagctccgcctcctgggttcaggccattctcctgcttcagcctcccgagtagttgggaatacaggtgcccgccaccacgcctggctaattttttgtatttttagtagagacggggtttcaccgtgttagccaggatggtctcgatctcctgaccttgtgatctgcccgcctcggcctcccaaagtgctgggattacaggcgtgagccaccgtgcctggccaactgtcatttttccccacaaatgcatcaaagcttgtttattaaaacaaatttattatgaatcaggattaattaacagattaacatttaacatactttaattgaagatattcatttagattttgttctgtcgtcaagtaatcacaaaagttgtagttaccaagttttctgccattgttgaattatcctggaggtcacatttttgtgtacaaattgatgagggacttgcttcgtagtataatttgagaggtggctgaactggcttctatagctagacatatttccccttttgggctagtgagtgcctccattagttgtcaccccttccattgtaagccgtttttcctcccgcattaccttataaaccacaaatgcctggaggagcctcagcatattaagacagttttgatcggtaccccttttagcagaagttattttttcagctgctttccaaagtaacagatgagagggaatttgaccttgtgaaagcaattgtgaggcagccaggtaggaggtgccgcaggaacactgagcagcaggggcaggaggccgtagctgtgtgtgtgtgagctggagtaggacaccttaagggaaatggctttagggatcaactttgctgttccacagtgctgtgaccttgggcaagagaaaagtctttaacaggtttgatttatgagaatattttctactctcgatagaatgcagtggatatctgatgcagttttgtgccatctaagtgactactgagagaagatttccaaatttctctgattgccatcagtagggagtgatgaagtgggattttcttttctagttgcctttatccgtgtcggtgaaatgagaacaaagctctctattctctcaatttagaaagaaatcagatctgaatctccaaaatcagttgaacatccttcaaccagtagttccgtgtctgatgtgtagacagtggtaactgccatactgaaagaaatgtagtcttgtgataattcagaactggacgtaaccaaaaaagtggtttttaatcacaaaattattttctggattgtaacaatttggaactggatataacccaaaagggtttttttgtttgttttttactcatgatataatttgtctgagaaaagcttccccagttgtgtggcaaataggttaggaggcctatttgagtaaaaatccaactgctgttacagtggaccttcagaataatttaatttggtcaattgtccatagctgtagtgaaattttgtcttaagaagcggtatctgaaaggaacttatgttacagactgaatgtcccccctcaaattgaagccttaacccccaaatgtgactatgaggtcataagggtgtggcaccaatccaacaggattgccgtctttataataaggggaaggaacatcagggagacatacacagaaaaggccctgtggggacacaaagagaaggtggccatctgcaagccaagaagagagccctcaccagaaaccaatcctgttggcacctcagtcttggacttacagcctccagaactgtgagaaaataaatttctgttgtttcagcaacccactagctggaattgtgtcacggcagcctgagcagactaatgcagcatctaattttaaaaaaatacttttcaaatattcaattttcccaagtccggtgatcaccacttggtttctgaatttgattttctattttctagtgaagaattttaccctgttccttcccgttctaggttcacagactgacttctggtccttgctgggggtgctgccagccttggaggctggtgagttgactttataagaaaatagaaaagcctaagttacagcaccagctttcttagttttccacagttcatggttctcctgtaggccactaatattcctgatacatctctctagcttttgtcataatcaaaatcggttgactgtataatacgtggtgcctgcttgcactgatgctgtgttattctgtttgtttgtttgttttctaaaggggaatcttgtagattactagagagttcatgatactctggtatcagttatgccacaaactagtattaatccatggacatttcccgccagcccaacctgccgcagaaactcaatttgagggttttctctatgtttctcgttaatataactttcatcctctgctaagttatcatttctctttacctggagccagaaaagtaggaccctgagccgaatctgcctctctacctgcttttgtaaatgaagtttcattggaacacacaaccatattcattggtttatgtgttatctatgactgttatcacacaacaacagcagcattgagaagttgtaaaggagcaaaaaaagacacagaaccatctgaagtctttgtgcagtggctcatgcctgtaatctcagcactttgggaggccaaggctggcggatcacttgaggtcaggagttcaagaccagcctggccaacatggtgaaaccccatctgtgccaaaaaatacaacaaaaattagccaggcatgggggtacacaactgtagtcccaactactcgggaggctgaggtgggagaattgcttgaacctgggaggcagaggttgcagtgagccaagatcctgccactgcactccagcctgggcgacagattgagaccctgtctcaaaacaaagaatctgagcctaaaatatttacaatctgtatatctatcttactaaaacatatacttaaggaaaaagtttgctgactattgctttacgttacctattggcttgacaagcccaatacattcccatttcttattagtacacgaatcataaataatactgagaaactataacttaatattgttaaatcttcttctctgtaattatagtaaaatttgagaggaattagtatggtatatccctatctgtttattaagggagtgtgtgtgtgtgtgtgtgtgtgtgtgtgtactatatgtttaataaaatcttaggaatactaggatttgttgagtagcgttcttatttaaaaaatgtgtaaaatttaaaattatgtaaatattcataatacagaagtcttcttagctttaaagatttacctgggtgaagacaggcattgtctgtacttgatcaagtaaattttcagttcattcaaaatgtttattttgcttgcatcttaccaaacctcaacttatagtcagttgaccaagttataaaagttctctttcattcccatgagatctcaatctatattggtggaggtgggagtagtaatattataaggcaaaatctctcatctgttctccagaaattaagtcttaacaatgttttctaagagcaatagccctgatgcagtgcttaatgctttatttccatatttgttatttctgactgctagaaagcaaaggtcactaggtcaggaaattagcttaagggggaaaaaggaaagtagttactcttaaggttaaaatccatatagtatgatgggttattgtgatgaatatttagttttgaaagacttcatttattatgtaatagccatatgcagttaacagaatgcttctgttagtgaacctcacaaatgatttagtaacccccagagattagctggatgttcatatgtagtagaagaagaaagcaaatttgacattaaaaacaacacataatgcaatgaaaacaaaataccccttaagagttaccatgtactatacaagacccaccagtcatccccagtaccattcagagcatgagattgattcagtcatgtccaccatctggttctataccggttttcaagtcccaatgatcatagttttgataatgtaccaggtaccatattaagggcttcatatgtaaataattttaaagtttttttttttaatttgaagaaacagaagtcaggttaacaaatatgccttaggtaaagtaaaattcaaaccaagtaagtaagagttcaaagtttatgcagtattaaaaatcatttctggccaggcatgatgactcacacctgtaatcccagagcttcagaaggccaagatgggaaaatcacttaaacccaagagttcaagaccagcttgggcaacatagggagaccgtatctctacaaaaaaaaaaaaacaaaaaaaaacaacaactaaaaaattagctggacatggtggcgtgcacctgtaatcctacctacttagcaggctgagtgagaggatcgcttgagcaaaggagttcagggctgttgtgagccatgattgcactactgcacttcaccctgggggacagagcaagaccctgtctcaaaatacacatacgcacacacacacacacacacacgtgtgtgtatgtatgtatgtatatatatatataaactttgtttatgtctctcctgatctgtaatctcttaaaagacagagactgtatttttctaattgtttaattcccctagtgctcatctggtacattttctacctagtgcagtcgtatcttatttagagtctcatttctaaaaactgtgcatagacaaaattggttttcaaaaccttttaggtaaagcccatgttggagactgacatatgacatttcggtaaacccaacacttctgattttcttcataacactggaaaaatatggctgtttttcagttgagcattagataaaggacttttcctatcctcaggggtcatgttgtacgtaaaatatattctttcatacaccagaattacactcaacatgacattgagaggcatgaagagatcaagacttactcaaagagttgcacatttatgtctctcttctcatgctcactgtggggcatagtattgacattgagagaaccctgaacagtattatccttgagcctcttagggcgtgatttaactcacataagttaaattcaccaatggtgccaaaatattgtaccaaatagagataaagacctcacattcctttagcacttactatatgccagccacattgaatgaactctgcacttaataattctcatgacactgcacaaggtatatgtcatcactgtctttgtgttatgagtgatgaagctcaggtgtgcctcagaaaagctgagtaaattccccagggttgccctgccagtgaatgccaaaatcaggatttaaagacctcaaatgcttttaactatctagctttgcattttccttaagaaatgttgattgaaaaattacaagtaatagtatatataatttatattttgtatatataatttatatatacatttatataatatctatttataacatatataaattatatatacaatctaaggttgtacactatctgcctttcgcttcaagttgatttttataaatagtcttctccatgttgtttctatattccaaagaattatttaaggtagtaaaatcatcagccatttgtaaataggagtccagtcatgcaaaccttagctatagccccacgaaggctacaacagctgggagcactgttcacataaaacacaacataaatgatgcccccacccaggatgcagaacaatcactgcccttgcctgctagctaggcactggattcatcaagaacattttaggaacagataaactcctaaaactctttatcacacttcattagttacattcagtgctatgcgtccaaattctgctcctgtacatgtttaataaacagagatgtctacacattgtctgattgtaaattgtgaggatttcagcatggtggactttgggtccataaacacataggcttctcacgtttatacagaaagtcaagcttgatttggggcttaaatccattgtgaaaatgcagtagatcttttaattaggtgaggatatttctaaagacatctttaatgtctattttattagtgatgataatgtaatcacaaaaacagctaaatccaaaatatcctctccacactcatagtagtccaccgcctataaaggtctttaagaaagcagaagcacagtgttcataaccttgctggcatgaggttaattcagaaagtcacttggtctttgctcttgacctcaaaatctacctcctgttaagaaggagaaaaaggaagaaaagcatttgctcgtcacttgtcaggaaataaaaggaagaaatgggatactgagagtaaagtagtatagtggaaacacgcattttctattttctacttaaagttccattacctttcaacattgttgatattgtagatgaagaaatgcttgcctactctctacaaatgatatcctatcccttacaagaacagataaacatagtggttgggaaacaatttaaattgtttctgagttctttggaggatttcatgtaaattcattagtaactctggaactatctactatgcatttaaggaattaaaaatgtattagtttcactacacaaatgtattagcttccactctgtagttaaatgaaaaatgtattagcttatatgtataaatatcttaacattcagtctgtagtattttctcttagatattactccatttgaactagtctataatgcaaacactgcttaaagtctcaatgctggagaattacactttttaaaaaattttcttaagtagcagaaaatatttgtgtatgcggcaatatttgtttaatatagcaaataagtattccttcctaaaaatgctctttcagaacttattcaatgctataatagttttggaaactgaagaaggatattactttttgaaaaatttgaaaaaatgctttcagaacttactcaatgctataatagctttggaaactaaagaaggatattagtttttgaaaaattctagggccgggcacagtggctcaggcctgtaatcccagcacttggggaggccaaggcaggtgggtcatgaggtcaggagatcgagaccatcctggctaacacggtgaaaccccatctctactaaaaatacagaaaaaaaaaaaatatatatatatatatatgttagctgggcgtggtggcatgcacctgtagtcccacctactccggaggctgaggcaggagaatcgcttgaacccgggaggcagaggttgcactgagccaagatcacaccactgtactccagcctgggtgacagagtgagactccatctcaaaaaataacaataaaataaaaaattctataaatgattacatacattaaccacttgaaatctaaaaaaaagaaatccagtattggggtgaagattttattcttagtagaaagacctggtatgtgccactcagttattgaagggattcgtttcatgtagtaactaaatatagatcagcaagacagatatctcggaaccatctaggggaatttgtaagttttcatcgaattttttttttctagtgagcgatgttgctgtattacacttaaactgaaacctattcactctctacgcacctgttcaatgccaccactctggataactgttaaaattcctttccctctatatctccttgaaaaatagcctgttacatctgatgggtcaatctgacaatctccaaagaaagataaaagtaaagtcaaaaaaggacagtgtgagatattgagataccaaactgtaattggaaatgaaaatattttctcttcatttttctggttctcccacactttttcctctattaacaattttagccatgccttatctcccatttaactgtaatttgaaagtgaaaaatctgtgagtaaaaaaggtgctgtttgtgtatatctacataaacattcatgcatctctatcccccatgtccagtggctccttcaccatggaataactagatcccaattttctgttcctttgtctttcagttatttttggaagctttcacaagggcgccttgaatgtgcccacagcaggacttgttagttggaggcaccacccagcatctgccctgctcattgcctattgtggctttttctggccatgttcagagcttgctcttggatcttgatgaaattgaaactggccagattgtcccatagcactgatgtttatggtttctttagaataaacatagaaactgaccctcccagtcttaaaacttgagaaagttacgtttgttgagttcctttctcaggaaaccaaccatcaggtctcccagatagtttcaaggaactgaaacttaccagatcaccacctctggacaatgagacaccagacccctcacgcatcattattgcctaaccgagcacctgcttcctgtggaccaacttctcttccttactcctccctaattcctgttttcccacataaggttacatttcttccctgctatataaacccctaattttagttggtgagacagatgaatttgagactgatctcccatctccttggctgcagaacctgattaaagccttcttccctgacaatacttgttgtcccagtgattggctttctctgcagtgaaaagcagaacctagaccaaaccccaaaccttggcattttggtattggtaacaaaagcttccaccacctattaggaggaagaggacaatagagctaattccacatactctaaaaactttacgtcatcaggcatcagaatgtacttcatcccctctcttctttggcccctctgttactattgaggaacactaattatgcttatgtaaattagacatagaagatagaatatttattgcctataggggctgtgtaatcattttatagaagtcagacacctacaacctgctcacctggggaaaaaaacccaggaattatttatctctactctttaaattatctgagttaataaacacatctagaattgaagtgttttagaaaataaataaaagtcctccttaatgcatttttttattggataatctccaaacttcccaacccaaactcatatctgtttattactttataactgtatccccactcctaatatgaacagtgaagtccaaataagcttataaaacccaaacaaaattacaaacaccaattaccaatagaggtagataaatttttataagcatcaaattttatgaagagtgttttctagtcatttaaatgtatttgctgctgaaggacaaaacagtattaactatctcaaaggcagtggctttagaattgacaataccctttcatatacatctctatatcagtttttaattatttgtaattatagtgcatagtttccattttcttttcctctttctttctttctttgttttttttttttttggtttttttttttttttgagatagcgtctcactctgtcacctagtctggagtgcggtgagtggcatgatctcagctcactgcaaccttgactttgagggctcaggtaatcctcccaactcagcctccctagtagctggatctacaagtgtgcaccaccacgcctggctaatttttatatttttagtagagacagtgtttcaccatgttagccaggctgttcttgagctcctgggctcaagtgatctgcctgctttggcttttcaaagtgctaggattacagtcctgagccaccgtacctggcctccattttctttacatacacaaggtgcttaaaccatttttttaaataagctaattgtagaggtacaatttgtaagtgaatggattaacaatttgcccatagttacaagtttaaaagcaaaatggattctgattccaggtatggcttccaaattctggcttttttaaaactgcaaaccatgatcaaagttagattaggcattcgatgaagagtcctcctttcaaaaggagccctcctttgccttatctctgaaaccagcagagtacacacacttcagttgctgttcttcaggttgtgcaatacaggggcccaagtatgtcaccccgtgattggtccctgcctcaacaagaaacatcactgagctctgaaggtacctctgctgtctgtgtctcttgggatttgaattcatcctcttgattattactgccctgcttattcaactcctataaatcctataaagcctgtatgttttaccatagttgtcaccacgcatgtgacattgggttatctgcctaacctctgatgtccctctagatctgtcatctaatactcatgcctacccttgcctaaatgtattttctacatttctaacttccgattacagacgcttcccttgattgactcttcatcgaatgcctaatctaactttgatcatggtttgcagttttaaaaaagccagaatttggaacccatacctggaatcagaatctattttgcttttaaacttgtaactatgggcaaattgctaattccttcatttataaattgtacctctacaatagaggtagataaatgataggtctttaatgagttacatgtataaactgccaaccacagtggtggaatttataggaatttaacaagtgataattattgttctcctcttgcttgactttaacttccaccttattggaaaaatttttccattaacttctaccttaatgcccattctcacatggcttcagattcatgaccctgtgcagattctttaaacctgttagtgctcttttggatccttgataatagcctttctctgtttccagcctcaccttcaaactcctggtttcatgtgattcagtgttgtgcccctgtccccaacagagctgtagcaataaaaggtttccctttcaggaagatgtgaatatgccttaaacctctttaagcccttaaaatgtaaatcgaattttatttgtattataaagaaagttgcggtttacaaattgaagatttctgtaatgaagaaacatttatctttttttttttactttctgacacacattcagacatgtcattagcttttttaaaactgcaataatcaataaactttgatacttacctattttaattctattcacaactcaaaaactgtatcagagtgaatttctttatatgaaaactaatatcgttgatgaaaccatttagctagacatatacagtgtgatgactaacaggcatctcgaagtcaacttgttgacctgacctcctctttttctcccccaaacctgtgtcacctgcacatgtccccatttcagataatgacaacttcatctttttcattgctcagaccaaaaccttaaattcttttaaatttgtttgctttctctcatgtccctcagccaatatgtggctttacctttaacatatgttcagaacccaactattagttctcaccaccttccatgctaccattctggtctgagacaccagcaagcatctttcttctggaatattaaaataccctcctcattggtctgccttttactccctacaatctattttacaatttggtctcactgcttttcccctttcctcctacactgtattttcaacacagctatccgagtgattcttttaaaaagtaaaccagaacacaacattcttttttttcttcaaaaacttgcattgactctccattttactcagagcaaagccaaagtccttctcttactctgtcatgtataacctgcactgcatccctcctcaactatctaactcctctcctcctaattctattctatgatattttcttctattcctatttaattctgtcctagttccactggtgccctgccccacctgttaacatgccaggcttgcacctgccatcaggctatggtctactactccctcagatcagtgcttgcccaactccatctcttcctcaaaaatttgctcagacctcaccttcttaatgaagctattctaaacacctatttcctactgcatcttacgcacttccctccacattcatggagctcccttaccctgttccactttttctttttttggtaacatttataaacttctaacacactatgtattttgcttattatatgtttaataaattcttcaagggcatgcatctctgttttattccctgagaatagtgcctggcacacagcaggtactcgatgcatatttattaaatgaatgaatttttctttgtctgaaataaatttatttggaaaatatttaacacatttgtgttttgtttagttggggttttgttactactgctatttctataaaaggttgaaatacagaagggaaaagaaaatctcaccagctatctggccttgtacagataaagccaaatgattgaatgcttgactgaattgactggttgtttggacatattttttgtaatagcttaaggaacaactaagctatctgacttccaccccctttccccgtgctagggctagaactgtcaaaaaggcacataatacacatttgggttttaaagaatttagttaattgaattcaatgaaccaaaagtacagtgaaaatcatcaacatttatatgtaaaacaaattctgtttttgtctggcttaaaggggatgtagctgggggctaaaggattagaaatgagtaagagaataatctgacattgctttgcttttcatgcaagctttgtaagctctcaaatggcaatgttggagaattcattacattgtggtaaagtatgacaagttgaagagtctaaattgagtaacaaaagcaaacaccaacatattatacatgaaaactgctgttgaaacaacagatcaaaaactgtactctaacactgtagcactttttatatttttctttattcagagattttgtaaggctgtttatgggttagcatggaaggaataaggctttctaccaaaagcagacacacagtttttgtacagaaatatgtctaccagggattatatactgaggaaatggtgaattgatggaaagaatacgataaacaaggggggaaatgtagtaaagaatcagtggttacctgatgcagttctttaagaaaaggatgattgggtagtgggaacacttacaaagctaaacagtgactgtgagataataactggacacaagaacagctctttaatatctagtgagtgtgtgtatatgtgtgtgtgtatatatgcacacatatatctttcacacactgtgcacatacacacacactttgtatgaggaaggtctatgatcagaaatactaacatcactattcaagccttgatgacagattttccactcctgtgataattcctttgtagctgattgactttggaaccagagagtcccttctaacaatgcagctattcctaggattataggttctcatcaatacctctttttaaatgtgtcacatttgtcaggtcacttttctctctgaaggaggcagtatcagagtgctggacagaggataagaggggaagagaataaggatgattaacaggaagagaaaaaaattggagggaggtcataaagattttccttgatttctcaattgtgccttggcatggaactaagacaaattctgccagatcacccattaaaagtcagtgtacttaataccctcaaaattaatgctatatacaacttcaactgtatgtttttttaaaaaagaaatgcaccaaacgcattacattttaatgatggatagaattaaatgctgtcatatgcttggcctttgcaaattgctccattaattattataggtgcttccagtgtgacatgtgagtattaaaaaaaactgtattgaatttatctgtaaatagatttgaaatgattggtgtacattctgttgaaacttcccagggagtacatattattcacattttttgtagacgtgaaagcaggaaacacttaaattgtccagaaatcagcctttgcattaaaacatctgcattattttattcctcataactgtaggaaatatctcatttaagcaatcttataagtcaactaaatgcaaataaattctccagtggagaatgacaagttcatcaacttgattccctcccactcccaacattttctgtcttattgtcaactgcttcacatggtctgttcagtggatgtgtttgtgcaccatcttcacaatgaccctagtctacattcctggttatatatcattactctaaatatcccccccaaactgtggcaaagctttgcagcacaatgaattacaatgcaatttggtatcatggaggtgaattttttaaattttgttctttgctgttttgccagagctgattgatgccagaaaggaagattgcttagaaactaggattctatgatagcctgtattgacagatgcaacttttaaaaccagtcagattgcaagccatttttacatcatattgaatcatatacttaattatgtctgtacttctttcacaccttaactttggtgaatctcaaagtatttcatgaaaacttggggaagacatcctccgtattagtcagggttctctagagggacagaactaataggatagatgtgtgtataaatgagagtttattaaggagcactaactcacatgatcacaagataaggtcccgcaataggctgtctgcaagctgcggagcaaggaagccagtccaaatcccaaaacctcaaaagtagggaagccgacagtgcagccttcagtctatggttgaaggtccaagagtagaacttgcagtacaatgtttgaaggcaggaagcatgcagcatggaagaaagatgtagggtgggagattaagcccgttcagtcttgctacactctgcctgcttttattccggctgcactggcagctgattagatggtgcccacccagattgagggtgggtctgccgttcccagtccactgactcaaatgttaatctcctttggcaacaccctcacagacatacccaggaacaatactttgcatcattcagtccagtcaagttgacacccaatattaaccattaaactctccttcctctattaaaccacataaattatatagactatctcacatctttagtgccattgcctgcctgcctgaccatgttttttatatgtgtgtacacatatacaggtatgtgtatacagaaacaggtatatgtatacattcttgtgtatattggtattatagccaaatctaatatgtgtagcttccctgtatttgatgaatcccctccttaatgtctctccctctgctcactgatcacacacatatttatttctgcacttaaaagatagatacttacatttttctgtccttctgtctttgttcctgctattccttcctcactcatctccacttgttgaaactttgtctgcccctcaagacccagggggcatattttgttctgattgtttgggtctcaattcaaaatctaccaacagataggctgtgtgatttgatgcaagtgatctaaccattctaaaccacagtgtcctttacagggcagtggggatggtaataaaatatacctcatagggcagatgtaaggctatattgaaataatctttttaaaacattatacacaactcttgccacaaaggaagggcttaaacaatgcacgctaaactctatcatctctatggagccccttttatctctatgtattaatctcttctcaagtgatctcatagtgatttgctcttagaaagctttttgtttgtttatttgtttgtttgagatggagtctctctctgtctcccaaactagagtgcagtggtgctatctcagctcactgcaacctctgcctcccatgttcaagcaattttcatgcctcagcctccagactggctgcaactacaggtccccaccaccacacctggctaatttttgtatttttagtagaggtggagtttcatcatgttggccaggctggtcttgaactcctggcctcaatgatccacccgcctcagcctcccaaagtgctgggttacagtcctgagccacagtgcccagccggaaagctcttattgaacgacgttcactagtctagtgacttgtgtgcatgtccatcttctgcattactgagcatgtatagatctacaataacaaaactgtgcgagatgctgaggatatagcagtaaaaatacaggtaaggaatccctgattacctttcaggtggagaagacacataaacaagccaacatcagtggcatattttcagatagtgataggagctataaaggagataaaagtggtgatgcgatagtctccattctgctttgtatgttaggagctacattacaaagagtagactgagaccacactattgctttagtttctctttcaaaggctccctgactccctatatgtgaggtcacaggcaccctatataaagctgccagagctatgcttcatagcttctctggcagctgcttcctccctttcattcaaatttatttgctctcatcagatttaaacgcattttctccttgtatctgatcaccccaccgtgtcttccattttactcagattaaggccacagtctgactggtgttgatttcaggttcatgccaagacactgtaagtaactctcattcctccttatgattccatttactactgcctaagagcacaagcgcagagccagggcatctgtccccatgtcctgccccccagtgtgtgttcttccttaaataaccaggtagggaagggcagataaggaagcccctacaggcaagtcctaatggtcttccaaagggaaaggaacttggtcatagatgctctcaataatagtaccaactcccatcgccgagttttattttagagtctcagaatgggtctagtgacacttgctctcataataaagtagaagaaacatttcttttggataaattgcccataggcttcattatcagaagctccatacatctaggtttctaacacttttaccatctttcaccatgagctcctttcagaaactctcttgagtctcagagccaagaatgaatgctgagggaaaagggagatgatatctatcttgccatgctttaccctgtatctctctgcctgtctatccatcactcaattcagatgtatactttatccttccttttttctgcaaaatacctctatctaaacctgagagcacaagactatagaagaactggatttcctaagtgagtccatggattagactcaccatgccctatagggtctgtctatagaggagtcacagaaactaggacatttgggctctctgaccaagaatcactgaaaatgggcgcaggctttttgtggctaaccctgagcatactagattaatatatctgtttgaagtgtatgttagggttgcatctagagataaacgcagtgactctaactgatgtcaagaaaagcaactaaccccttgtcttgtattctgcaaacatctagtattattctgcttgttcccaagacacaggcttcatgaattaatgcctcctttcccagttaaatattcaaaactcatttgcctaaactaagtggcaaagaaaaaaaatttaaagatgggtgtggaggagcattgcttgattgtaccaaaagcatttgattaaattgattggagagctacagccaaattaacgaagactggcacaccttacctatctctttctcttatttttcagacatgaaaattgctcaggcttcaagtctagtctgtgtgaaagcattaagtgtttcagaaatcaacatgtcttatcaatctattgtgctctggggaaaaaaaaagccagttagtgacattatttccttatgttctagaaacctgataataccttattgtacatcaggagtataagcaaatttcattgtaaagaggttcttctgacaagatctgtgaagaacatgatgttattaacttagacgtctgcacttacaatatagcttttccaagacaatttttgctgggctacaggtggttatttaagacaatcaatttacatagaacaatttattcttttttcatgctgttaaagcaaattggtatgtaattagatttatatactgaataatctcatttgcatatccaattaattcttcctgttttaatttgctagggttgaattcacattagtagtaaaaataacacttaaattataaaggcctcaaaattttctttgctgtaatttgttcaagatgttgcatttaaaaattggtccccagcattctttacaaaatctactgggaatatgtgaaagattttacttaaaagtgcccttagccaaatatcacacttgaggttcactctttgttcatgatgaagaggttaatggatggtagaaagctagtccttgcctcaatacccaataatattcaaaacaaggaaaactcaggttctgttttcaccctctgacctttcatgctttgagtatgtttaaacactgagacatacatgcacagaaatgaaatctgttcccaaataatttatatttattcttcaactgtatcacttcaactattgttgtttaacacagtgggaatatatatactgtagacaaatattattctttttggattcagatacaccagagcttagtatttgtttgtttcttttgccacttctgatattgggaaaccgattttgtctatctaagagtcagtgtcctcatccttaaaaccaaaagagaaaaatatgtgcctttctagaatgactaatttcacatggcataacatataaaagtatctactagtgtggatccaacaatagaagatgttcagtcagacatggtatctggtctgtaataaacatatataaacactatcaatcaaaatgaatattcaatttctaggacttcatagtatttttattaagttcagtgaatgtttgttagtggccattttcattaccagactttagattcaaatattggctaagcattttgtgcaaattatttagtctctctatgccttagtttcttcgtgtgtaattcgggaataataaaaagtatttttacctcgtataatcgtggtcagaattgaaggggttaatacataccctcagactattccctggtgcatagtaagcactcaatgaatgttaaccatggctatcattgttaccatgttgaaagaataggcacccatatcagagtttctttattgttatctattagtaagtgtaagagtgttttaggactaccttaacaaagtaccactgactgtgtagcttaaacaacaggaattaattttttcatagttctaaaagctagaagtccaagatcaaggcttcagaagtttagattgttcctgaggactctctccctggttttcagatgatcaccttctccctgtatcctcacatggcctttcctctgactgtatccaaatttcctcttcttataaggacagcagtcagattgggttaaagaccaccctaaggtttcatttaacttaattacctcttaaaaggccctgtgtccaaatacagtcacattctaaggtaccaggggttagggcttcagcatgaaatttggggaaacataatttagctcataatgccaaggttgaatttcccttatatctggtagagaccctgaagctctgttttcagaactgatattaaatgtaagcatatctgtgtacttaaggtatttaaaaagcaaggccaggcacggtggctcacacctgtaaccccagcactttgggaagccagggtgggcggatcacccgaggtcaggagttcgagatcagcctggccaacatggtgagaccccgtccctactaaaaatacaaaaattagccaggcatggttgtggacgcctgtaatcccagctactcaggaggctgaggcaagagaatcgcttgaacctgggaggcagaggttgcagtgagccgagattacaccattgcactccagcctgggcaacgagagcgaaactcatctcataaataaataaataaataaataaataaataaataaatagcataagtaacctatgccttatctcaaggtcttggcccattttctgcagctacagccatgctttcaaagctatacttttattttctcccctcagatttttatagcctgtgcatcagattcatgtaatagaaatgtcataacatttatattaggtctctattccagagacctaggcttacacctcatatttgttgtttgttgtataaatatacacatacaaattacctaaactcaggcaagtgattttacctccatgagacctccttttacttatctgtaaaaggggacatatttcctcacaaacagatgcaaactaagacaggatagggaaaagaattttgtaaattctaaattgctgtagagataccagctgtctctgcttactgaaaaggcaatcttaattccattttctattttatggtcattgttagtttacagttactaatattaaatggctttagtggtcactttaggagagacatttactttgttgttaaaccaatatgtttacaattagatataagtttctttctggatttgaagataactgtaatttgcagttgacgcttatgcaaattgctatgttctgctgcatacccattttaaaatacaaatccttcccagtcatcactgagtgtatataacaactgcaaagaaaacgctctgaagatttttttttcctgtcaaaatgccactttgccttcagaaccaccatctaaacattatcttaatgacacttactttatttggaatgccagtatcctttgtgtaattttcagatagcctgcagatatttgaaaaactttaccagcttcttcatcatttcagtctgggaaatgagcatcctattactggcatgccttgtgttattgtgctttgctttattgcacttcacagattttgagttttttttgcaaactgaaggtttgtgccaacactgcatcgagcaagtctactgccaccattttcccaacagcatgtgcttactttgtatctcagtgtcacatttttgtaattgtcacaatagttcaaagtttattcttactattatatctgttatagtgatctgtgatcattgatgtgaccattgtaactgttttgggataccatgaaccgcacccatataagacgaagaacttaatcgatcaatgttgtactctggctgccccactggctggcctctcccccatctctctcccttctcctggggcctcccttttccctaagaaacaacaatattgaaattaggccaattactaaccccaccgtggcccctaagtgttcaaatgagaggaagaagcgtacatctttcactttgaataaaaaactagaaggaattgaccttaatgaggaaggcatggtgaaagccaagacaggctgaaagctatgcctcttgcgccaaatggttggctaagttatgaatgcaaaggaaaaattcttgaaggaaattaaaagtgcaacttcaggcaacgcatgaataagaaattaatacagtcttattgctgatatggcaaagtttgagtagtctggatagaagatcacaccagccgcaacattcaacattctcttaagcgaaagcctaatccaaagcaaggccctaattctcttcaattctgtgaaggctgaaagaggcctggaagctgcagaaaagaaggtggaagctagcagaggttgcttcatgagatttaaggaaagagatgccacctccttaacataaaagtgcaaggtgtagaaacaaatgctgatatagaaactgcagcaagttttccagatctagctaagataattaataaaggtggctaccctaaaaaacagattttaaatgtagataaacagccttatgttggaagaagatgccatccaggactttgataagtagagaggacaagtcaatgcctggcttcaaaacttcaaaggacgggcttactttcttgttaggggttaatacagctggtgactttaagttgaagacagtgttcattgaccatcctgaaagtcttaggacccttatgaatcatgccagatctactctgcctgtgttcttttatggaacaacaaagcctggataacagtacatctgtttacaacatggtttgctgaatattttctgcccactgttgagacctactgctcagaaaaaaagattcctttcaaaatattacttgtgtttgacaatgcaccttgtcacctaagagctctgatggagatatattaggagatgtatattgttacccttccagctaacacaacatcgaatctgcagccaatggatcaggagtcattttgactttcaagtcttatttaagaaatgcattttataaggttatagctgccatacatagtgacttctctgatggatctcggcaaagtaaattgaaactcttctagaaaggattcaccatcccagatgccattaagaaaatttgtggctgggcacggtggctcatacctgtaatactagcactttgagaggctgaggcaggcggatcacttgaggcaaggaatttgagaccagcctgaccaacatggtgaaaccctgtctactaaaaatacaaatatatctatctatagatagatattttacatataaatatatatatttataaatatatataatataaattcatattatatgtataaaatatgtatttttataaatatatatatatatataaaagggaagggaaaaggaaggaaggaaatttataattcatgaaaagaggtcaaaatatcaaccttaccaggattttggaaattgattccaaccctcacggatgactttgaggggcttaaagctttcaatggaggaagcaactgcagatgtggtggaaatagcaagagaacaagagttagaagtggagcccagagagagaagtgattgaatcgctgccatcatgataaaacttgaatggatgaggagttgcttcttatagataagcaaataacatggtttcttgagatggaatctattcttggtaaagattgtgcaaattgttgaaatgacaacaaaagagaatattatgtaaacttagtggataaagcagtggtggagtttgagaggattggcttcagtttgaaaagaattcctactgcggataaaatcccagcattacctgctgaggaagtctgtcatgaacggaagactcaatcaatgcagcaaacttcaatgttgtcttattttaagaaatggccacagccaccccagccttcagcaacatccaccctgatcagtcagcagccatcttaatcgagggaagactctcccccttcaaaaagataacaacttgctgaaggctcagataatcattagcatttttaacaataaattattttaagttatgtacattgtgttttttagacataatgctattgtacacttattaaactgcagtatagtgtaaacatgactcttgtatgcaatggaaaaccaaaaaacttgcgtggctcattttattgcagtatttgttttattgcactggtctggaactgagcttaagatatatctgtatagataagactatgaatgtatgaaatttcataggctggaggtatcttaaagaacatctaattcatttacaatcctgttataaaggttatagactctttactatggaacgcaaggatattaacatcttttactagcagacattgagtgaacaagtttatatgtcaaaaagactgttacggtcttttcctttctgatgccttctaagacatggtggacctaccagggtaaagattcaagagtggccattgcagtctatttaacagctccattctttcaccacctcctttgatctcatctttttgagcctctttccttgcagtgaagggacaagcagggtagaaaaaaatattcccttaggatcctcttgcttcctttgtgctcccgatgatccctttgtattttcaatctgtgggtctctttaatgcctttattctctccttctcccaaaaatagtgtcagttcaccaaggacaccacataggtagtcagtcatttggttcgatcagattctcatggaacctacaagacaagcacccttttcacttttctaggaatggcctcctcttagcatataatctgggtgttacactgaaaaaagtctagctcttcctttgattgagtagcattatcaaaattaccaagggccaggcacggtggctcatacctgtactcccagcactttgggagactgagccaggaagatcgcttgagcccaggagtttgaaaccagcctaggcaacgtagggagacctccatctctacaattttttttcttttttttcttttttttttttgagacggagtctcactctgttgcccaggctagagggcagtggtgctatcttggctcactgcaacctccacctccctggttcaagcaattttccctacttcttactctcgagtagctgggattacaggcacctgccaccactcctggctaacttttgcattttttttagtaaagatggggtttcaccatgttggccaggctgatctcaaactcctgacctcaggtgatccacccgccttggccttccaaagtgctgggattataggtgtgacccaccgcacctggccaaaaaaaaggtgttgtttttttttttttaaatagccaggtatggcggttcatgcatccagttctagcaacttggtaggaggattgcttgagctcctaccaacatttttcgattgctgaggcaggaggattgcttgagctcacaaggtcaaggttgtagtgaactatgattacaccactgcactgcagcctgggcaacagagcaagaccctgtctctgaaacagacaaacacaataacacaccaagaaatttgggaacagaagggaaataaaaacctcatcccaattacacattcacttacaaaacagatacttagaaagtgcctaaataagtactagtaatttatgtagtaccagtggaaagtggtctaatagtcttattatttcaactactatccttatggatctgctaatctaaacagacacctctctcccaaaatacagtaagtgttcagcagataatgaaaggggactgctgtgcagctgctgtggggcatggcattgaaactgaatccaaagcccactgggtctgtgaggtagatggaatgtgacagggagagaagagagaaaagacttcctagagaaggtgccaatgtttctaggcacacaggaataacaaagaaaactcagcaggggcccagagcacagggacttgtccaatgagatgagagaagcaaggaagtagtagtacaggtctcagtggaatccttgccttagtatggtatgtgattttttatagtgcagagtggatctcgtgtgtgaatgtattctccatcgtagacgtgtggtcgcttatcagtgtggtcacttatcaatcacatttaagctgttgtttaaaatacttatggatcttttcttttggaattttctttacggctcctattttattcctctgaatatttcaagtgcttgtaaatccttgtcctttgaagttagatttcatttttggcaacagctaagctttccatatttagaaacttgttcagagccatttcatggtaaatgttggtgttcatgctgggtaatactgttttttggtcaaaaatgaattgtgactataaattaatgaagctaatttttttgtgtggcttataaatcagttctctatcatttttaaagggggaattttaaaacatacgcgttaatacatgtgaaagcttttttaaaaattgtaaatctccacaatttttaaaaattgtaaaaaaagcaaggactttttttatttttattaatcattaagttatattacatttcaacatactgctttaaaactcaataaataagttttaaattctcttttaaactactagtttcttaagtaattgttcatttgatgttgtctaccagttgagcaactggtacattaaccagagctgtagattgagctcttttccaaatatttagattttgggttcatagagaaataccttaagagaattgtcaaatgaggaaactgacattcagaaaggagaaataagtaaggtatctaagatcacaagggtagtaattgacttaccaaataatatagtttcaaatccctgacattaagtcaactaaagattggtcttttcactgatgtagatctagtcattttagtcagaaatactcttctttctcctattttctctctaaaacctctgccttcaacctttgttagtctccccatctctttttgtattgcttctatctgtgtgagggtttggataacaagaagatagtcttctttcctttatatttcctttatttttcttcagtgactactcaaaaatcttacccagaatggacactaaatgaatgaatttctaattgttttgcagctttctcttctgttaggatcaagtgaccagttcgtctctaccaaacccaggatgtgtttttgatttatgtgatttgtggttttgagttataagtggttccataaggccaactagcagctagaaaacagtaagtttgggactgtaaacagttacagggaagtggaagtttttggttgttttattgttgttaattctttgttttgttgcccttggtagacaaaacttaagtgatgatagagcttacagttgctaatttacccaattccatgctttgctttttgaaagcaattgctgtgtttcccttcaggggatgagctttatttactccttctactccaaagctgagctataggaattcaagtggggtctggaaataccattgaaaaaaagagtttttttgaccaccttggcaatggccagttgtttctttccatggccagcctctttgttgtttgttgagaatactgtctaagaaaatcccctcaaaattagaagtctctgaaaactatacagatctcaagggcctaaaagggaatgttatcattttaattattgtgctactttcaaaattatactgtttgtaatcatgggtattgaaaaagcccagacatttgagtttaattatgtgctttgtaatcctaagatacaatccttttttctcatgcttttatataccgtgtttctctcttttctccaacacttaataaggccaacccaagggtattaattccgggaatgagtaaaaatggtgttattctttctcaaagcctagtcaggtcagtccacaagcattcagccctgctcacagtatgtatttgaagaatgtatctttgtttagaaaagaaaaggaaggtttgggaagagtgtggattaatattatatgctgcttccctttgggcctgttttttccccccagtcctttcttaccctagcaaatacagttaggagtcctggattgcacattgtaagaacaaataggaatctgcaggccttcctggaaggtctgggtcatagcagcttctttgcttcttcttcttatcttctgcgtggcactagctagtatgccccagataacacagggaaggaatttgactccttgacatcttacatgcagccaaacacttcagaatgtatagaactttctgaatccaggtagcatctcactctgaatgtcagatggatttttaaaaaatttattccccaaataattgtttatgaggaaattttttgtctctctaaggtgcagccacgtagagtcacttattctctgaagggtcccaccctataagtgatataaatcctgatatttcaaggaatttagaaaatatgtttgttttattcctcctccctccagtgtgatacagaatcttaataaggagcctatgttgccttttgaatcattaactctgaagaaagttcaggaatgttagacttgggagattaataactgtaactgcaaagagaagtcttgtctgttaaagaatttgtgtgcactattgcatcactcagtatgtatgtgaggctttctatttttaacatttttaatgacaagctgcctccttggttctgtatgcccttcacctttgtcagaatgagattgatagtgaaagtttctctgctgttctcataaaagttgaattaagggtcttgatttcggtttactgtactgcagcattatctctcattcatctagtggtctcttctctgtttctgtttcctgctctgcctgtattctagcatgcagggcagttggcagggactggccatgcaaaataatagctgtttccagaataagtcattgagtcatctgaaagtacaacattatagtgacatacctgacttctctataatgcagaaaagggagtcataataacttaaagcattgcacattgccagagctatttgaaatgacggaacatgaatattttgacatctagtagtagcctagtgcctctttgccagaagatgctaatgaaacaaacatggaaatcactgcgggattaccaagactgttttgactttctttcaggataatcccactgggtttttaacttgcaaatatctgaatgcccatcacatggaggaggaagctgatttgtttgcaatagaacttgaaaaaatggtgaaaactaaagatactttctaccttggatttcggatttgctttctgataattagagatatctcaaaaataaaatggactttctggaatggaaaagataagaatgttttattgtcctcgaggcattagaattgtaaccgtatttggcgagaatgttgaagagtagcaccatgcatcctagggaatttttaaaacaattaaaagagaataattataagtcaaagttatcaggaaggaaggacagatgtaatctcatttcgctgcatgatagtaaatgaaggtacatataatatttccaagagagaaaaatttactcaaagtccaagaaattcagagtaaattcaaatggataagaaggtaaaaatgtagtctaaggattataactacttctgcccatgcaaaaagcagttatgtttataatcccagattaaattgcccagaagtatcatcagatcccctatctggttctctttagagcatgtttcaccaactgtaatcaaagatttgtttttatgactgattgatgtctgttttctcccagtacattgtaaattccatgaagacagcaactatgtctgttctctgtttgaatcccaagctctagtacagtccctggagcataatgcggactaacttaacatttggtgagtgaattaatgaatgaatacattgtgacaattataatgtgacaataaattattgagaggtcaagtctcaaaagggaggtctaagctaattaattttctgaatgtgtatgcagtactagcttatgtacaaaaatctttcttcagatgtgtatgagtcagcagcaactggaacttggaggtggtctttagaccccaatgtcggtatctgttcaagtattctattcgtaccttatcagctgtcttccttttcctgtggtggaaggactgccagtttcatctaagtggtttgcctcagagttcaggagaatagctcattgggagttctggtcagatattttcaaactcaaatgagtaagctctctgaaaaacctatacataatgaaaaatagtttaagattacagtggtgttttgatgtgatctggaacagttcacccactcctacttggcaataaaaataaattatgcaatgggacagccaactgttacagcttggaaaactgttaaaaactcaaaataaatacgtaggttaatgtcatgaagtacttgaccggacaagcatatttttccaattctaagggtagaaagtgtctttgtaaacattcctacatgtcagaaaactaaataaaaatgacctctagcttcgaggcacttattggaaacctattttacattgaatacacaagccaagataatacagactgtttgataagaaacattagagaaatctgtaacatgaggctttttattataggtttattacatcaatctctccagtgggtaatggaacttgtaaatatactcttatgtaggagtctccttgtgggctttttattcatgctgaagtaagcacagcaaacttatttgctgtcagggtacattgaatttaagattagtatttattttggttctaaggaggttttgcgtttgtgaattgaaagttggatcagctgcatgaaaacaagatgggactacagggagcacaggaagtaaattagttttttctaaatatgcattctgtaaacctacgtatttagctagcatggggtgcgtatgcgcagtttctcagatgggtgagtcatgcatcggatgtgtatgtttatggctctgtggtttgggtagagatagatattcaaaatggcatattgcagttactgttttctaatgcaaatcgttctagagaaaaaatatatatgtttataagaaagatttcttaacctctttttgaccagtgactttcttaatttcagtgggggcatatgaaataaaaccctcaaaatcatcagccacactgtaccttccatatcattgacagataacactgacaaattattccggcttgttctgacacctgaatagaatgtatcaggtggtaactgaagccatgaggatgagttgcccatacagaggaaaggattataatagtaaatagctatgttttatgaatgacatactagatactgtgcgaagtgaactagatgtgttatttcatttaatgctgtgcttatgagacagccaggtcggagggggtacctggcaaaactccagccagcctgtgccctggggtggacccacaggaagttcgcaccttttgcagcggggaggagcctggctgctcctcttcctgtgtggaacctgggattcggcagggtgggaagtgctctgtcagggactctggcccagcaagagtccctgttttccttttttcttcctttcacccaataaaaccctgtcttactcacacttcaaaccgtctgtgagcctaaattttcatggccatgggacagacaaggaccccatcattagctgagctaaggaaaagtcctgcaatacttacatcacatgactatgaaggcaggtaccatggacactctcatttgtcaaagacggaaaagtaaagcacacagaggtaatacgatttactgaaattcacacaaataaatttaaagtctgttccatctatgttgtgttgttaccttaggatctcacttcatatttgtgaagaatcatccttcccatttccttaaatacccaaaccatgagcatttgtaccatcctttattccttttggacatttgcagcagaatgtctattttgtttaatattagctcataatctgggaagtgagtagtagtattcacattttatctgaagtaagtgagacttagagaggtggagtgacttgcccaggcctgatttactgggtcttagtttcaagcctttttttataatgaagctcactctatctccaatagagcatgttcaaggttctaggtccagaaagggataagctgcaaatcatgaatccataagaataaatacctacttgcatttttttatgtggacatgcaaataacacacccacacacacaaacagacacacacacacacacacacacacacacacacacacacacacacagaactaacctaatatttcaggtctcatgaattgtatttggtttaaaaatacagtgagatcagaaagaatgctctgttcaaaaaaatcacatactttgtctcattagagacagaattgatactctttattgaagagtaaaattcagtaagaaccttcttaaaaataggagcaggccaggtggtggctcagacctgtaatcccagcaatcttaggaggccaaggcgagcagatcacttgaggtcagagttggagaccagcctggccaacatggtaaaaccccgtctctactaaaaatacaaaaattagccaggtgtaatggtacatgtctgtattcccagctactcgggaggctgaggcaggagaatcacttgaacccaggaggtggaggttgcggtgagccgagatcacatcactgcacttcaccctgggtgacagaggagactccatctcaaaaaaaaaaaaaaaaaaaaaagaagaagaagaagaagaaaaagaaggaagagagggcaaatgtgtattatcttataggtattaccctagtctgcagtgaggtttttgttctcttatgtcctataaagatcagtgaattctaacgacttttacactaatgttcaagttggtccttaattttattatttcccttttcacttatttgacttggctttctacataccagatggtcacctgagcccagagccacatcttttcatttgttatgctttacaatttgtcataatatctggtatatttgatatggacaaatatttgtttgattgttttcttttgatgtggtgatgtttgaactcatcctaaatgtacacaatagttttgagagacattttaaacccaataacatgtaaatttcttaaaacattgctcctgttcagatacatcgaactggaaacctggtcagggattgtgtgaacagcttcattttctcactataccttgtacatgaaatcctatttctgtttgtcttttattggcttttaaaatagcatgacgatctgatgcacagtcactgggctttggcaaatctctatttcctcccagccacagaaatttacatttcttcccaagctactctgactgtgaataatctatgtgaggagtgacctcagttcatttgaaagcatccaacatcctgaaaactgtaaagccacagcacgcactgatttctcaaggtctaagagatggtttataaatgattaaaaaaaaaactctaatagtatactcaaaacattttttaaaaaaagaaatagagttatgagtctgcaaggacttatttaagaaagacgtcctaatattgggggaggtggattcactggcactgttatatcaaccaagtatttcatgtgtgaggagataaagcagcaaactacgcaaaataaacagcgtgtgttcaccttagatatctaggacgcttcactttgaataaattttctctgcttttttgaatccagagcaatattgtctgttagacaagttctgggttttgtctgcttcaggcctgtcttaaccctgccattaattggcatatgtccaggcaattaaaactgtggtatggagcaaattaaaaaagagaatttaaagcaccagagtcatttgaaattccaaggtcaaatggaaataacattgaattatcttcttttggggattatacctgcctctatttgtctccaccagaggtgataatctagactttggttacctactctttgcatcctcaaaacgggaacacacaggaatgcttttttccgaaggccagaatgacagatataagattgaagttaaacacaactgatgcccagcacgtcagagcaggacaaagaatcagaggcaatttaatcccacctttatgcttttgaaagacaaaaggaactcaagcccagaatggcaaaatgatttactaaaggtcatcacaactaggcacccctctaattctggtaataattaaaatcaacaatatttattgaacactgacctttgccaagcactgtttcaagctcttcccatgattttttggtattatagttaaggagcggaggtaaagggacagtgaaataagtatcctctatatcctactactaccaaacagtttttcttcagctgagccaatagctaccatcttccaactaattcttagccagactaagatgacaaaggaaatacactaagcatgatttagctttttcttatgtctccagttgttgttttgaaagtgtattcatggcagggaaatatcccaaagccaggcagccccaaggaggagtgcctctagcatgagtattccagaaagtcatcaacctctgaatacttaagttgaccctgtgatttatgtatctaggactgaaataaaacatttctgactttctatacaagattttgcaatgtttatattagtcaagatcagctttttccaaaacatgctcgatggatcactcccttctcaggatgctgtataagaaagaagcaaaaaagctgtgatcaaataatttttgtttaaaaaaaaaaaatcctggccaggcgtggtggctcgtgcctgtaatcccagcactttggaaggccgaggtgggcggatcacctgagatcgggaattcaagaccagcctgaccaacatggagaaaccctgtctctactgaaagtacaaaattaaccaggcgtagtggcgggtgcttgtaatcccagctgctcaggaggctgaggcaggagaatcgcttcaacccaggaggcagaggttgcggtgaaccgagacgccattgcactgcagcctgggcaacaagagcaaaattccatctcaaaaaaaaaaaaaaaaaaaaaaaatcctgcatcatcctgatgatgttcattatcatatagaaattttaagaatacccgtaataaatgttttttaagtcagcatttcccaaattcagacaaacacagaacccaaccccctgccaccttttgttaaaaaattcatgttaaccttcctgcagagcagatatcaagaaagatgtgtgagaggaaatttcattcaaaaaacacttatcaagtgctgatattatagctgatgctgggttatagagatcaaagacccagttccagaattcatagagctcacaagctacagaaagagataagcttgtaaatcacagttataatacagtttagtaattagtgtcatgcacaaaaataggggatgtggagctagaaattaagatatttcccatcaccttgctgttgaagagtagtactgactgctatattatattatccctaaattcagaggcttaatttactagaaatttagatctcactcatataagattcaatggaggagagtggcagcaacaactatggttcatacagtcattcagggatgcagattaatcttcagtgtgtgactttccagatgtctttggacatcaacatccagctgctaaacaggaaaagagaaaagttaaaaggaacactgtgcaagatgcttttatgatctaggcctgagaggatacatttctttcacctgtggtccaatggttcattcatataactacaactaactgcgagagaggctaggaaatgtgggctacttctgggtcctgcaaggatggggaaagggtttggtaagcagctaactagtctcaacctcaatgggcaatatgaacttaggcaacagaaggtatagggaccttccaggcagaagtaatcaactatctgttgacataaaggaagggcaatcatggcactattgacaccctacgaaaagtatgatatggcaagagtagagaccacctgcggaagagtgtaggagacaggatggctgggaacagtggctcatgcctgtaatcccagcgctttgggaggctgaggtgggtggatcacttgagatcaggagttcgagaccagcctggccaacatggtgaagccccatcttcacatttgtattttagtatacaaaaattagctgggtgtgatggtgtgtgcctgtaatcccagctgctcaggaggctgaggcaggagaatcgcttgaacccaagaggcagaagttgcagtgagccgagatcacgccactgcactccatcctgggcaacagagtgagactctgtctcagaagaaaaaaaaaagaaaagggaaataaagacacaagatcatgtgagctttttgtactatgttaaggagcttgtattttactttttcaatgatggcgatttattaaagaatctaaaaatcattgaactagaatcaaaaaagtgagttaagagattaatggtatataataggaatagataatgagctaacaagtaattgatggcatagaatagggatggattcaagaagtactgtaggtaaaatatacatgacttggggacccagtgaatgtaaaaagtgaggaagagagaaggtacagtcaagaatatttcctgggcatgtctggctagttagatattgttctgatttattaaaaacaagagacattgggaaaggaatttggtaagtgggaggaactcataagggtctgaagtataggaaggaggttgaaacttgagggtggtcagcatgtaggtttccttgaagcatgtggaatgaatgcagtctaaaggagaaagaaaatcgaggcatgcagagagcttagaacaaaaccacacaccagaatttaaagggctcaaagaagaatttgtccatgaagaatctaaaatgataaagagaaccaagggaagaaagaattttttaaaacaaggtaggaaacaacccacatgtccatcagctggtgaatgcatgcatacaatgtgatatgtctgtaaaacaatactattcagcaataatagggaataaagtactgatgcatacatattacaacaaagatgaaccttgaaaacatactaagtaaaagagtcctgtccaaaaagaccacatattgtctgattctatttgtatgaaatgttcagaatatgcaaatctattgagatagaaagactagttgttttctggggcattgagaggtaggtgggggtggttgggtagtggggaaaagggaacaaatgctaatgagcacaggttttttgcaggaattaggaaaatattgtaaatttgattgtgatgatggctatacaactttgtgaatgtacttaaaactattgaattatagactttttaaataggtaaattgcatggtgtatgaactatatctcaaagctatcagttaagaaaaccaaaaaaggaaagtagaaccagtgaagtttggggtaatagaaatacatacgtcttctaagccagcttctggaggcaaaattcaatggcttctaaaccaatcctgtgattttcttttttggtccagaattgcatttgcatttttctgtgggaaacacttctactttatttgcagatggtcacattcttaaggcatttagatcatcacctatattttttttccttaagtaagtctagattttctgtaaattagcattgaattttatgataagtaagttggagaagttttatatagtaaatttctttcaatatcaaaattatcttgaagataatacacttagctataaacatgtaacctcccattatccagggttatatagtcaatatctagactttcagccatgcctgggacccaaagtgagcccagccacatcttatcagaggaaagcatttgtcattttacatttaaattcacatctgaggtattctccaggttttcttggaactgcagaaatatcaccgttatacattatttagtaaccagcttgctttgcaaaggtcaggttcgtgttattcaaagcgtgatgcttagtatgcgatgacacaaacagatttcttgctttaaagtaatagaatgcgatgagtgaaaccaactttctttggaagaaagatgtctcctttccacgacatttgatttgtaagtgggtttggcttcattaatatttaattgtctttttaatctgtatgtcagttcttattgcagactgcttctggggaggttttcctctgaaataccaataacaaccattcttcactctaacatcaaaacaagggctctctccgggacacctagttgtatttcatctctagggatataattattttgtcgttatccacagttcctcaagggactgatgatgtaggacaccctccttaaagacctttatatgtcaaaagaagaacctgatttgttaatgttgcaaatactaattcagatggtcttgcatcattcttgtgagttgccttttcttaaccaggctatacagaatttgtacttttttattagcacgttagtggagtttgaagctgttagttgatcttttcaggatattttcatgagctttactagtttaggaaacagtgctttttctgtgggatgcattttgaacatttaaattcattttcaaacacaaatcagaatagggaatgaaatgataaacaaccctttataaattttcaacttgatcacctatagcaataaagctacaaaaagaactcagaattagtatctctggagattgacatagagaaattgagattgacatctctgcagcaagttgagcctctttgtgaactggtcatttttatttcctggtcacttgggagaaacctgggtgaaaaaattggacatctgtttttgtttgtgatagcaaattccctatgggatgagcctcaccctaattaggggaccactcttggccctctcaggagagaatataagggtagataaggagacttaggttaccctctcaatcaatcacagtggggcaaaatggaataatttcacacattttcctttagctggatacttgatatatgagaaaaaatatggggtatccacatcctaaaattttaacacttccctgtgcttaccaacgtggcgtgtggtatcagtggaacggatgctttcatctgccttttttcgaaggttagttgtggcattgccttgattagtcaaagattttatctcttggtaaaggatattatcgatttagatagacacattttgaagttagaatacagcttgtaattatgaatgggcgaagatatctgacccttaaaaaattcagactccctaagttgtctacgcagcatgcaggttcacctgcactggtatcacacccaagctagcaatagaacaaattcatttgactttattttatgacttttcctagaagagacataacaatgaatcatcttgttatccaagccaataaatatgcttccttttagatttcttaattcagtttgccagctattttgggtattagaataacgggtttcatgtccttggggggtttaatttgcttccagagtcttgtttttgtagaatagcttaagtcttcatagtcatggtttatgattcttcaaataggtcattataagtaagatctgattttgaactggtattaagaaaatagacattgaaaaaaactgtttcagggaaaaaacattttcctttctagatcatagtgcaataagtggctcttttatgatcactgttgatttttccaaagtaagacattactgatttattttatctatgttagctttttcttccaaaacaattccttgatgtaattttatcataaggaataaaatgttctttttttatttttattttttattatactttaagttctagggtacatgtgcacaacgtgcaggttttttacatatgtatacatgtgccatgttggtgtgctgcacccattaattcctcctttacattaggtatatctcctaatgctatccctcccccctccccccaccccacaacaggccccagtgtgtgatgttccctttcctgtgtccatgtgttattgttcaattcccacctatgagtgcgaacacacggtgtttggttttttgtctttgtgatagtgtgctgagaatgatggtttccagcttcatccatgtccctacaaaggacatgaactcatcctttttcatggctgcgtagtattccatggtgtatatgtgccacattttcttaatccactctatcattgatggacatttgggttggttccaagtctttgctattgtgaatcatgtctcaataaacatatgtgtgcatgtgtctttatagcagcatggtttataatccttggggtatatacctagtaatgggatggctgggtcaaatggtatttctagttctagatccctgaggaatcgccacactaacttccacaatggttgaactagtttacagtcccactaacagtgtaaaagtgttcctatttctccacatcctctccagcacctgctgtttcctgactttttaatgattgccattctaactggtgtgagatggtatctcattgtggttttgatttgcatttctctgatggccagtgataatgagcattttttcatgtgtcttttggctgcataaatgtcttcttttgagaactgtctgttcatatcctttgcccacttgttaatggggttgtttgactttttcttgcaaatttgtttgagttccttgtagattctggatattagccctttgtcagatgagtagattacaaaaattttctcccattctgtaggttccctattcactgtgatggtagtttcttttgctgtgcagaagctctttagtttaattagatcccatttgtcaattttggcttttgttgccattgcttttggtgttttagacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctggccatttttcctagcaccatttattaaacagggaatcctttgcccatttcttgtttttatcaggtttgtcaaagatcagatagttatagatatgtggcattatttctgagggctctgttctgttccattggtctatatgtctgttttggtaccagtaccatgctgttttggttactgtagccttgtagtatagtttgaagtcaggtaacatgatgcctccagctttgttcttttgactcaggattgtcttggcgatgcgggctcttttttggttccatatgaactttaaagtagttttttccaattctgtgaagaaagtcattggtagcttgatggggatggcatggaatctataaattaccttgggcagtatgaccattttcacaatattgattcttcctaccctggagcatggaatgttcttccatttgtttgtgtcctcttttatttccttgagcagtggtttgtagttctcctggaagaggtccttcacatcctttgtaagttggattcctagctattttattctctttgaagcaattgtgaatgggagttcactcatgatttggctctctgtttgtctgttattggtatataagaatgcttgtgatttttgcacattgattttgtatcctgagactttactgaagttgcttatcaacttaaggagattttgggctgagacaatggggttttctagatatacaatcaggtcatctgcaaacagggacaatttgacttcctcttttcctaattgaataccctttatttccttctcctgcctgattgccttggccagaacttccaacactatgttgaataggagtggtgagagagggcatccctgtcttgtgccagttttcaaagggaatgcttccagtttttgcccattcagtatgatattggctgtgggtttgtcatagatagttcttattattttgagatacatcccatcaatacctaatttattgagagtttttagcatgaagggctgttgaattttgtcacaggccttttctgcatctgttgagataaacgtggtttttgtcgttggttctgtttatatgctggattacgtttattgatttgcatatgttgaaccagccttgcatcatagggatgaagcccacttgatcatggtggataagctttttgatgtgctgctggattcggtttgccagtattttattgaggatttttgcatcgatgttcatcaggtatattggtctaaaattctctttttttgttgtgtctctgccaggctttggtatcaggatgatgctggcctcataaaacgagttagggaggattccctctttttctattgattggaatagtttcagaaggaatggtaccagctcctccttgtacctctggtagaattcggctgtgaatccatctggtcctggactttctttggttggtaagctattaattattgcctcaatttcagagcctgttattggtctattcagagattcaacttcttcctggtttagtcttgggagggtgtatgtgtcgaggaatttatccatttcttctagattttctagtgcatttgcatagaggtgtttatagtattctctgatggtagtttgtatttctgtgggatcagtggtgatatcccctttgtcattttttattgcatctatttgattcttctctcttttcttctttattagtcttgctagcagtctatcaattttgttgatcttttcaaaaaaccacctcctggattcattgatttttttgaacggttttttgtgtctctatctccttcagttctgctctgatcttagttatttcttgccttctgctaggttttgaatgtgtttgctcttgcttctccagttcttttaattgtgatgttagggtgtcaattttggatctttcctgctttctcttgtgggcatttagtgctataaatttccctctacacactcctttaaatgtgtcccagagattctggtatgttgtgtctttgttctccttggtttccaagaacatctttatttctgccttcatttcgttatgtacccagtagtcattcaggagcaggttgttcagtttccatgtagttgagcagttttgagtgagtttctcaatcctgagttctagtttgattgcactgtggtctgacagacaatttgttataatttctgttcttttacatttgctgaggagtgctttacttccacctatgtggtcaattttggaataagtgtgatgtggtgctgagaagaatgtatattctgttgatttgcggggagagttctgtagatgtctattaggtctgcttggtgcagagctgagttcaattcctggatatccttgttaactttctgtctcattgatctgtctaatgttgacagtggggtgttgaaatctcccattattattgtgtgggagtctaagtccctttgtaggtctctaaggacttgctttatgaatctgggtgctcctgtattgggtacatatatatttaggatagttagctcttcttgttgaattgatccctttaccattatgtaatggccttctttgtctcttttgatctttgttggtttaaagtctgttttatcagagactaggattgcaacccctgccttttttttgttttccatttgcttggtagatcttcctccatccctttactttgagcctatgtgtgtctctgcacgtgggatgggtttcctaaatatagcacactgatggatcttgactctttatccaatttgccagtctgtgtcttttaattggagcatttagcccatgtacatctaaggttaatattgttatgtgcgaatttgatcctgtcattatgatgttagctggttagtttgctcagtagttgatgcagtttcttcctagcctcgatggtctttacaatttggcatgtttttgcagtggctggtaccggttgttcctttccatgtttagtgcttccttcaggagctcttttaggacaggcctggtggtgacaaaatctctcagcatttgcttgtctgtaaaggattttatttctccttcacttatgaagcttagtttggctggatatgaaattctggtttgaaaattcttttctttaagaatgttgaatattggccccccactctcttctggcttgtagtttctgcggagagatcagctgttagtctgatgggcttccctttgtgggtaacccgacctttctctctgtctgcccttaacattttttccttcatttcaactttggtgaatctgacaattatgtgtcttggagttgctcttctcgaggagtatctttgtggcgttctctgtatttcctgaatttgaatgttggcctgccttgctagattggggaagttctggataatatcctgcagagtgttttccaacttggttccattctccccgtcactttcaggtacaccaaacagacgtagatttggtcttttcacatagtcccatttttcttggaggctttgttcatttcattttattcttttttctctaaacttctcttctcacttcatttcactcatttgatcttccatcactgataccctttcttccagttgatcgaatcggctactgaagcttgtgcgttcgtcacatagttctcgtgccatggttttcagctccatcaggtcctttaaggacttcccttcattggttattctagttagccattcatgtaatcttttttcaaggtttttaacttctttgccatggtttcaaacttcctcctttagcttgaagaagtttgatcatctgaagccttcttctctcaactcatcaaagtcattttccatctgctttgttctgttgctggtgaggagctgcgttcctttggaggaggagaggcgcgctgatttttagaattttcagtttttctgctctgttttttccccatctttgtggggaaaggtctacctttggtctttgatgatggtgacatacgacatacagatggggttttggtgtggatgtcctttctgtttgttagttttcctcctaacagcaaggaccctcagctgcaggtctgttggagtttgccggaggtccactccagaccctgtttgcctgggtatcagcagcggaggctgcaaaacagcaaatattgctgaacagcaaatattgctgaacagcaaatgttgctgcctgatccttcctttggaagttttgtctcagaggagcaccggccatgtgaggtgtcagtctgcccctactggggggtgcctcccagttaggctactcaggggtcagggacccacttgaggaggcagtctgtctgttctcagatctcaagctgcgtgctgggagaaccaccactgtcttccaagctgtcagacagggacatttaagtctgaagaggtttctgctgccttttgtttggctatgccctgcccccagtggtggagtctacagaggcaggtaggcctccttgagctgtggtgggctccacccagttcgagcttccaggccaatttgtttacctactcaagcctcagcaatggtgggcgcccctcccccagcctcgctgctgccttgcagtttgatctcagactgccgtgctagcaataagggaggctccatggatgtaggaccctccgagccatgcgcgggatataatctcctggtttgctgttttctaagaccgtcagaaaagtgcagtattagggtgggagtgacccgattttccaggtgccgtctgtcacccctttccttggctaggaaagggaattccctgaccccttgcacttcccgggtgaggcaatgcgtcgccctgcttcggctcacacttggtgcgctgcacgtactgtctgacaatccccagtgagatgtacctggtacctcagttggaaatgcagaaatcattcgtcttctgtgttgctcacactgggagctgtagactggagctgttcctattcggccatctataaaatgttttaaatatgcaactttccattgctcaaggcagacaggacccttaattggttttttaacattgaaattcattaactagtttagtaatagttataagaaattttctatgaaccatccagctactggtttaaggccctggggattaagaatctgtccttgcccagtaggagcttacattcgagtgggctagagaatcacgtaaatagataattgcattgcaatttgataactacaataatagatattcaaagtacaatgacagtactacttaccggtttccaaaatatttttgtacttgtctaatggcaagtatgttattttgcaaagatttgtttttctctccggtcaatacaatatacagggcagtggtagaattcttagatggaaaatacgcaatctatggtcaaactatttgggtttaaatgcctggccttaataactggaaaacaatgagaaatcatttcatctccccaagctttatcccagaagcagtaaaataggtataaaagggagtgcttttgggtggctatgtacagtcgatttatgctatcaccttacatctgggtctaagccagcttctcctggcccaactagatcgctcttgcagagactgattgcaaaatataaccctgaattcctcctatacagaaatgcacactcctttgcaatgtggctttcctgctcttcccatcaataggtggactcttacttccctatccccttagtctgggctgggcttgtgacctgctttgatcagtagaatgtggcagaagtgatacttctgaggctcagttttttgttttttgttttgtttcgaggtggtgtctcattctgtcgcccaggctggagtgcagtggcgtgatctcggctcactgcaagctgcacctcacgggttcacgccattctcctgcctcagcctcccaagtagctgggactacaggtgcccaccaccacgcccggctaattttttttgcatttttagtagagacagggtttcaccatgttagccaggatggtcttgatttcccgacctcgtgatccgcctgcctcagcctcccaaagtgctgggattacaggtgcgagtcgctgcgcccggccggagggtcagttttaagaggccttgcagcttccacttttgtcatcttggaatgttgctttgagacctccatggcaggaggccagtcttgcctaccagaggatgagagcccatgtggaagaggacagaggcaacccagcagactgccagcaccaactgccagacatttcagtgaggccatctcagaccttccagcccagctgatgctccagctgaatgtagccacgtaagtgagcccagatgaaagaaccatgagaaataataaatcattattgttttaaccgctcagttttggagtagtttgtgaaagcaatagataattgaagtacttaccgcatacaatccatatgcctcataataaaagtagcctttttaaggtagcctttttaaacacaaactgatttcataaatctgaattcctcatcacgtttttttttatattttttaattgacacataattgcatatatttatggggttcagtgtgatatttctattgatatatataatgtacaatgatcaaatcagggtaattagcatctccatcagctcaaacatttactgtttctttgtgttgggaaaattttaagttctctcttgtagctatttgaaaatatgcaagaaattgttaactgtgtccaggcatgctggctcatgcctataatcccagcactttgggaggctgaggcaggtggatcacttgaggtcaggagttcgagaccagcctagccaacatggtgaaatctcgtctctattaaataatacaagaattagctgggtgtggtggtgcatgcctgtattcccagctactggggaggtggaggcaggacagtcacctgaacccgggaggcggaggttgctttgagctgagatcaggccacagcactccagtctgggtgacaggatgagacttcgtctcaaaaaacaaacaaacaaaaaaacaaaaaaaaaaaaaaccattaactgtgctatagagcactagagcttattcgtcttatgtagctgtgaatttggatctgttaaccaacctctccctatccccacctgcccctatagttcccagcctctagtagcctctattctactctctactttcatatgattaattgctttagtttccacatataagtgagaacacgtggtatttatctttcaaatattttatggataagacctcaaaagcacaggcaacaaaagcaaaaacagacaaatggaattatgtgaagtaaaaggcttctgtacagcaaagaaaacaatcagcagtggagagacagtcttaccacatatatatgtatttttttttttcagttagcttcctcaggttgaaaaacacccatattttttaaaagttgtcttccctacatgatctggcccttcctgcctctcctcaccttatctccttccatctcctctcttatctctattctagccacactcccagaacatgccaagccttttcaggctccgggacttttgttctctctcttttctctttctggaattattttccccagactttaacatgcctgactctgtctcacatataagttctcacctaaatgccactttctcagcaaggtctttgactttctaaaatagttccaccctctcagccagccaaaacttacccaatttccctattttgatagcgcttatcactatctacaattatcttgtttatttatgtttccatttattgtctgttttttccaccttcccaagaatgaaagctccacgaagaccaggaaaagactgatgggccactgtgtgtccagctcttagaaaaaggtctggcacatagtacatgcttagtaagtacacattgaatgggaggaaatagctgttctgaataatgactcaaaataacagagggaaagcatctaacaggggacccaggtcttgagagcagcaccagcaactcaaatacgaacacacgctgctcttcctactgttaccatgtctgaaatgctttctttgtgctggacactgctaagcctaatatgtctgttatctcatttgtttctcatatcaacctcaaagttctaggttctagatttattatcctccttctaccaacaagaaaactgagtcttagaaaagttaaacaactcagataaaatacccatgatttaaattcatgaagtttaactctaagttccattttaaaataatataatgatactctgatttcttttcagattgtataaatctttcaccttttaaaataatacactggactattactgcctgaacaaattactgtttatattattattccacttttatccctccctcctacatgatgataatattttacttatgtttagatcctgaacaccaaacatccagtgaatacagctgaagatgtaaccgactgagtggttttttttttgtggtggggggcacagagtcttgctctgtcacccaggttagagtgcagtggcatgcctttgggtcactgcgacctccgcctcctgggttcaagcaattatcctgcctcagcctcccgagtagctggaattacaggtgtgcaccaccaggcctgactaatttttgtatttttaatagagacagggtttctgtatgttggccagactggcgtcaaactcctgacctcaagtgatccggctgcctcggcctcccagattgctgggattacaggcgtgagccactgtgcctggccaagactgattattaatgaactaattctacctatacaatttggaggtatgggagacagcatcatggagaaacctcatttgaagtgcaccttgatgaatggatgagcaagagttggccaggtagaaaatagcaattctaggggaaagaaacgacatgggaattttttcagtgttgtttttgaaatttacagaatttggaagaaaatgtttcagtaaggaaaacttcctgatggtctttatactgttttcaagttctttggaaacttcagaaacatataaaaagacacagtttttgaaaaagtggaggggaaattattagagagcatgtatcatccagcgaagactaactggatgacattcttaagtagtacttggtgtttgtccttaattgaaagatgtttgtgtggactaggaacatctaaatagacttttcaatctgtaaatgaaatcttcagagcctgcagggttctggttttttaagtaagtatctgtccgaggaatactctgcacatcaaataacttaaatccagtaacatgtgataactgttcagggattagcacactggattctattctctctctctatagatagatagatagatcactcttttagatagatagatagatagatagatagatagatagatagatagatgtgtatatatatagatatatctctctctatatatgtatatatatatctatatagagagatctatatacctatatatctatacatctatgtatatagatatagatcctgaacaccagacatccagtgaatacagctgaagatgtaacccattgagattttttttttttgtggtggggggcacagagtcttgctctgtcacccaggttagagtgcagtgagatctatgtatctatacatagatatagagagagatctatgtatctatacatagatatagagatctatgtatctatccatctatccatctatatctatctatctatctatctatctatctatctatctatctgtagagagaaagagcacacacttacgactggtttatcttaacaggagctttaggatgtctggaaagtaatacagtcttcataaagagaggttgaacattatcaaacagcatggttcattgtgagtttttgttttaagcattttaaacagttgacttcaaattcccagcagatggtggtggcagcaggcaggcactctagtcaatgagaagtcaaagtgaacttttaaaatagttgattcttaaacttggaagaaaaaggagtgaatgttagaaaaaaaaaataacaggtttcctgcaatgcatcttatcatgcacaagtcaaaaaatgagaaacggtacaatttgcaataaacacaagagtgtgtattttacactacggaaatgtaaagcatttaatcagtctgttagcagaaaacttgaatattagctgtcaccaaatccctttagtgtataataacctcagaattgcggaccaatgtgttttcctcccagcaaagcttaccagaagtgttttcttaaagactggcattcctattaataatttaaggtaggaaaaaaagggggtacattttcttcttagtagtccaatccacaatataatgatgatgatgatcttactatacttaataccactcttattgtagtgatttttcttttaatgctatttttggataagaggtaattatttttaattgttaaactactttctatagattttttgagcacttcaaagtctagaattccaggattctgtgaagaaattctttttcagccctgtcgtaaaaaaatttttttgatccttggtcatgtttatatttatcctgtccttaataatattgattataacttctcttttcagtgaatatattatacatgttcgactttatcttactaggtagctgcttaataacagccaaactcattatttatgtcacttatcttccccttttagttatctttgtgtttaggctcctactctatggcggtgaaagcaatggttgtgggagggaaggggaagttgcttgatgtaagtgaccggaaccacaagaaatattcccagtataaagtgaccctgtttgcagattacctttctgctttatttcctatgctgtatcttccattttctaggattcctcaggccatctttgcatggttggtttatcagaatgaagtaaaatagctccggatagaatttggcccctccaaatgccaggcccatgagatagcaaggaaacttcatcaaatgccaatgacaggaaaagagctgtatgtcttacgaagcaggcccacattaagtctgtaggactgcatggcttttctcttgccctagaaagtcaacagatgaggtaactccccacccaactggttccttttctttacttggatgatcaaggggtaaaagtacagctgtcattttagctacaaaggtacctttttacattaaactgaaaaagtgcacatgtgttctgttgaaatgccccctatatatctgttttgaatttcagttcactgaatgttctgaaaattaaataaacacaaaacaggacatgctaatatcttcaatgaggtgcttaattccccatcttaatcagccgttttccatcctgtttctttttcctgcctatctgtcaaatgtttcttaattaagaattattcttaattacaaagtttatgtgtcattttattttagaggtagttaattaaatttaacactaatcattggagatattgccttttctgcacacacattgatgcttaattattggaataccttgaatctcttgactgagggggagtagggcatattgatttgtgtctggtatgtggcagctcgtactgaatagggcagagactcagcccatcaaccagacaaagaagtaggaagctcattttttcttagttgataaaggacagtgaacaaatgcactctggtcattcagcgcattatgtgatgtctctgaggggcatggaagtgtgatgattatggatgacattcgatcctaaaaagaatagccagaataaagctattctttaagagtccttggatacttgttagaatggatttgccaatttttgtatgtatgggattatactggggtcaccctgagcaggtcatctggttggatgagaagcgagatccagtggccagattagaaaaaggatgcattagctcttggttccttctacccaatctttcccctccaacattctcagaccttatctcctgggtcacttcttcagagaagtcttccacaactatatattgcatacctttccttgacatcattcattctcactataattgcaatttatgtggttggatttttattgtctgcctcacccaataaatgaagtatccttgagggtagttgtcatttctaattttgcttatcatttatttgtcatttgcttaactagtatttgacactaaatatattttggaatggattaatgaatgaattattaaatatttttagaagctataagttatttgactttttaaaaaagtattaaatgttcattacgtttgccagcactgtattattaggttctgggagtaagggatggttgggtgaaagtgaatccctgccttcagcaatttataatacaatacaaaagaaactcatccaactaaatataatataagctagactataatatgtggtgtaatagatacatgaacccatctctgtgaaaacacatagcaaatcagccaagcgaggcaaggcttcaaaaagagggagattatttgaaatctgccttgaaggtagttttggacaaataagaactggggaaagggcatgctgggaagaggtaacaagatgagcaagagtcagatgtataaatgaatatgatgttagcaaattgtcaaagattggaaaacatggtggtgctcagtcctggctcggatacagtgaggcaggctttctgtacactgttggcaggactgcaaatgggtagacacttttggcaaaacacgttagaagactcactatttcctcttctagaaatatatttcataaccggagatgtgtgcaattctttatattcaaaattgtttctcacagcatatttgacaaacttcattaacggtctacacacataattgtagtccaatgattacatgaattatgtaataactataggatgaaaaactatgcatccattaaaaattatgtttttgaagaatcatgacatggataggtgcttggattgcagtgtatataaacataatgaaaatctcaatataaagttggataccagttttatacatgtaaaaatacagaggaataaaggaaataacagtaacagtaatttactaatactaattctctttggtggtagattgacaagtacgttccattttcttctgtatgttttctgttttctagatgttctacagttgtaaatattggttgcataataagaaaaacagatttaaacttggatatgttatgaagaaaatgcaatatcatatctatggctaaaatacaaaatgtatagggaatgcttttagaaaatgagtcttgagttttaaaaattatttagactctaatgggggttgtgccttgtattaatcattctgggtaccaggaaaacctgcgagatacggcccgccacccaaggattttaaaacctggctgagaagacaatacataaatatctaatttaataacaatctcagataatagttctagtaataccatggggcaggatgctacagattgccaaaacatggcacataagctatggcctagaagtttagagtagagattagcctattgagtaattatacagaatttctaaatgttttttgtcatctccctgccacacccctggagcagcgtgtgatctcaccagcagtgcaagggcacatgggctctcaaatacctgccatagcaacaggatcaggagatgacttagagaaggtggagaggagggttaagagaccccagaacttatatggctagaggtccaaaaacaagtagatgccactcactggcctgcctgaattacgtatctttccaatggaccccaacctaaatacctagatatgtaggttgtaccttttctgtatatgatgaacttgatatatgtgcaccccttacgtatgtatacacatgtatgtatattctgtatatatttgtgtgtgtgtttgtgtgcataccccatatatattcatgtataaatatatatatatatgtagaaatattttctaataatcactcagtttctattgcaggtgattatataaactctcttaaatggatttgccattttcattatttgttgccataaatttgcttcatcctaaaatactgcttaattactagattggtcaacaacatgtatcttgctataattgaaaaatgacttacattttggaaaagaataagatgaatatttttccagataccttgggaacaaataaattcctccattttgagtgttactgtaaacataaaatactagaatgggatattttttggatattcacttaatgtttttgtgtttgatcttccaatatgaatcgttatccattcacagatatttataaatcctctactaggtgcaaagccattgataagtgttgcaagaaaataaagtacaagttaaagaacatgagtacctgttgtctacagatactgagaattctagaatatataaataacactccttgaccatgaaacatttatgatctcttggaggaatcttgtgaggaaaggtgttgattttgccctcaaggcggttctgtcaaccttttctacctgtgggctgaagagatcaaggacctcttcatggaaaaggtggctcgttcactaggctctaggttacaattgttcttaacttttttttactgaggatgtcagagacccctttagtcatgtgatgaaaataattgtttcttacctgcaaaatttacaagcccagcatcttgtatttaatttcagtaatttatggattctttctaaggtaatccacgtgcatttagtttacagacccccacttcaatgagtagttagaatttggacatgcactaggctaaaaacaaaggcaattttaggtaacaatacagaagcaaagtgtataaagtatatatagaaaatggagagtagctccatttgaatacctggaatgggttaattaaagatctagactgaaaggtaggaattggttaaataaagatctagacaaaaaggatcaaattcctaattactgaaaattgcaccctgtatcatatcatatcatgagtccatttccagtggcctgccttttagctattattagtcatcacttaatccaacaaaagtgcccaatcttcccagtttcatttcaggacaagcctttagcaacaacaaattttgcccttatccttcacggagtagattttctctgccgccagcatccaaatgtgcatttgacactctgaaactgaaggagagactgggacagaccataccaatcactgaccccatcattcagagtgattgagatctgtcttgtcactttcctgtgtggagacattttctctccttagattctctataagacaaaacaatccaccaccattatttttatagcatgcccatctcccagagtgtcacaaactctttacaacaagaaatggaatagaaagacgatgctttgcagacttgggtatagttattttcagacagaaagggaaaatgacaagaagagattgagtggaataaaagtaaagataaggctgctgacttgaaaaaacagtcatgacaagattgatagaccctgcccaaatccacatctctcacctgcacacatgtacacacacacacacacacacacacacgcaggtggatagtctcagcagcttttatcgaaagttttgttgatgatgtggtcttcctgatactagttttcaatgatagaattacatgcttattcttgaatataagtcagtttggtctctctgaacacatgtccacatgttgaagttgaaatgagttaatggatgtaaacatttagaccagtgccttacacaaatgaacacacttcgaatgtttttccattattattgatgttgataatggtgatgaagatgatgatgattaacagtagtatagtattaacttgtttatcagaaaaaaaaaattgtggaacagaacaagaacccagtaaggtaataagtctttttaattattttgacatttgagcaaaggtaaacacatataagaaatctaagacttgcattctgttccttccctaggagtgttccaatatcctttcaggtagtggttatttcttaaaacgtccttttatcaccacctgccatagaatcacttgtgttacttcttaaaaacatggattcctgggctctaccttaaacctaccaaaaaagagtctctggggacaggtcccaaagccagccttttaaagaaattccccatgatgagtcttaagcctacaaatttgagaaaggtgtttacctatcgtttaaagaatcaaccttacaggcagggtttaatctgattaggaatagtggaggggaacactggctctgaaacatctttcaccactttccctgcaattcacactattaaatatttattcctttggtttccagtgtatatataggagtctccatttaaaatttaaatacaaggggaagccattaacatccattagcacaccatgtgagttagggatttgaaagccaatcatttagcaaggcttcaaggggagagtaagatgaatgaatcccattgaggaaaaaagagctaagaaggcagggagcagaataggccagcctaactgaagcattgcagctgagaatcctggacagctaggggagtaaggaaacaatgaattctgcagaccagctgctggaaacaaaaaaaaggagaaattatacaaagtggtataaaatgcttttcaaatatgtttgtggtagaggtggaccccaatgaccagttttgtctgtttctctttaagtgtggcctacagtagagtctaatgctggacccatgcatttgaaggtctaatactgagttaaagatctcggcataaatcctggggctaataacattggaccctgagcaagtcagacaaaattgcacctagatttagctaaagagtatcagctaactttgttttaagaataaacgttttttctcttcacttataaatactagttctcctaaattatttttcaaagtacttacataagcttcaacattttttccttgtctatggtcatatttaaaatagtttaacaaaaatttgttgcccatgttgttttgttgtaatctgtatgaacatctcattgtacagattaaaatgataaaaggaatcgggagtgctcaagcaagaagatttagggggagacaaagaagagaatttacttaaaagtgtaattagccaggccagggccttgttcagggatcagtgtgataatttatacttatctgaacttgtgaaacgtaaagattacattcttgtgaaatgaaaactacatttacttagcgattagcttttttttacatggcaattagctttggtcatgtgtatacatatacattaagatcagtaatatttatctgtcatcttttccttgtgtctacattagctaccatctggtctttaacctaaaaatgtccacatcaggaatcatctttatcagggtcaagtaatgggaataaaaaggcaaggtaacttttattgcagaactgaagaggagatttgaagagaagtaactttggcatcaagaatagagaagtaatggggagtgaatacttgaggtgtcctaatccactttctattaccttcaattggtgataaaaatgttaatgatgatcttcaaattcaagaatacacgtaaatccccaaggaaaccaaagggagcagtataattctttacctgactttcttgcatctagttttatttcagtttaggagctagcactgtcccatacaatacaagagcatttggtcttgtactaagaaaagacttagaaaaattgaagggtccttccaaacaaatgtggctgttttgacaattatgcaaatagtgtgaagattaaaaacccaagtaatcttcataggtcatggtattgatttaaatgagaaaacctaactgctttttgttttttgagttgtgttgggatttttctttttcttagtgtgttttttttgttgttgttgttcttgttgaagcatgacacttatctgtttttccttgctagattaaagccttgctttccctttgttatttaaatcacatcagcaaggaattaaagagccttagagcaggtggctgtggtttgggtttacattagtggactttttgccattatgtttctattccaatttccagtttcagttagcaacattatactctgtgattttgggcaggagaaaacccaaaccacagactaaactgatttttgtttggagaaaatgcacaaccaattcccaattacccaagttgtatttcaatcccagagtgcatggaatgaaaataattgcaagtgtgaatacacacaaaaagaaatacatcctgtacagaaaactagctccctcactgttggtaggagaagaaggatatttgctctggagtggtcagggagtcctgttactgaataaggcccttaacttgagagtacctttattaagaaagcagatgagtgctgtaggggaagctagcaacatgcatgatgcatgcagcctgataatgagatgcccttctagcaatatttaacccttacattaatccaaatctacctccttataactcctgctttttggattaaaaagcaaagtaagcccagtgcttctaacagtatgagagatcacagcaaatgtttaaaggcagtgaccacgtcacccactccacccaaccctacccccgacacacaccccatctcctccaggatatagtttcccggttactgcaatcattcctcagctccaaatctctatgccctttttcctttttctcttttccttcttctcaataaacagttttattgagatataattaacatataaaattgtttgatgtttgcttttgtgcatacattatacaatgatcaccacaatcaagctaatgaacatattcatcacctctacatggttactatttgtgtgtgtgtctgtgtgtctgtgtgtgttacacccttttctcttgatggtctctgctttcacatttcactaaagctgtagtaccccaacttctaagtcctgtgctctgagcacatgcaaagtttgaccatgctatcctctgctgtggactttcttatcacttctataagccagttttagtttatactgacatctgcccactctgggttgaattcctacctgctgtgggagaaaacaaacagtgtacaaatcattgccaccaaaaagtgatggtgtccaagtggagatgctttggaggtcattaacaatatgacctgaggtttaggaatgagagccaagctaaagatttaggtttgagattccttagctcagaggtgttaatgaagccacaggtggccatgacttggtctgtgaaaagggcagactttaaatagggaacagtgatttttcttcagcctagtaatgtttgtccacacagagtttcaatcatttaaatatcaagagatctaacagaaatgtctgtgtttctgatttccgttggtgatataaaaagagtggagttacatgtctgcagtgcggcaatagcctaaagctgagcagacattgccttctataggcagggcacatgctctttggttccctgaagttcccaccacttgctgctcagcaacttcacccatttacatgccagcctgtcttctgtagacattttaatttgcaatatctgatagacaaggccaagcactgtggctcgtgcctgcaatctcagcactctgggagaccgagacaggtggatcacttgagcctggaagtttgagaccagcctgggcaacatggtaagactctatgtcttcaaaaaaaatacaaaaattatctgggcatggtggcatgcgcctgtagtcccagctacttgggaagattgcttgtcctcaagaggtggaggttgcaatgagccaagattgcactactgcactccactccgaacaagatcctgtctcaaaaaataatatctaatagacaatagtaaacatatatctatgcctttgatttcattctctcctgctgatcattcagtcaattttttgtaatcgaatgggaatttaaagtgtgcctttttgatagggttttcatcaagttattagagagatgaaagccatctaatgttagtgtaggaagaaatcttaccaattatttattcattttacaaatggagagaatgaaactcaaagaggccagggcagtgaaactcagagaggccttgttcagagttgacaataagttaatatcacagggaggatagaactcaggtcacactgttcttcctaagtcttagaatctttagctattaacataggtactgactggtatatttgctctcaattgaacagaaaagttgagtacttgtatctggaagggaatcaaaacaacaacaacaaaagataaaaaataaaaatctgtaactactttgataacttattaaaatatgaaaatacagtatacagttattgaaggaattataaacttctttattgcagttgtgtttgaacagtgccttttaaaaaataatctgcttatttctacctattgagagaaatagctattttttcagtattttcctttggaccacattgagttttttccccaaacacagtttgtcattcaaccaaatgaaaaggtcctcaggcaccaccctccacccaagaaccaaaggaatcatttgatgtgaaaggtacgagtcatgccaggctcggcaccagccaattaccgattacacaagctgtattttatcactccaaatacatggaattaaaataattgcaaatatgtgtatacacacaaacagaagtgtatcatatgcacacagctccttgatggtggtagaaggacagggatatttactctggaatgagatgtgattcctgttattggacaaggcccgtaacttgagcccacacttattaacacagcatatcagtgcagacagcttgataatgaggaaacatccagcaaggttaactcttcagcaaggttagaggcgtgaatagtctcatccagttaccagctgaatatttttcagagaatgcccatttccctagttaagtgtttctcaaacttagctccctacgtgggtctttgtaaccacactgggaatgcatggagccatctcctgaacccaggccagtgagctaaacatttctgtggcccagtcactagtgacggttgagcattaagaacattgcaaatggtgacaatctaggaaccattaagctacagaacaggtccaagatgaggagatacgtccttacagaggtctaatgtagcacctgagaattacagaggtctaatgtagcaccagtcatccacagttgagactggaatctagtctaacacgacagagagttcgaaaggttgcagacataagaaagtaacagcagtgtgtgaaacatcacttcctgatttccttgaaagcaacttagttctgactgccaacctccatccagttcttgccaggttgctacggaagttgctttgctattcttatgggagccaacccaacccctagcattgtacacagaaaatggggaaggagatctaaattccagtcaaagttgccactgacattcccattgtcacatcccaagtggttccttgaaatatggctgctctcagctatctgccactagaaaaagaatcctcactgaagttataacatcagtagcttggatagcacctccctaggcacatcatggagcaagcctatggtagagggagcattttggctccatgcaaatgcctgactcccacagaaccacattttcctcccagtccagaggaaacttgccattcttttttgtgacttgcctcaacccatttgtctgcatcttgccagagaccacctgcttttcaatgaccttttaccattccttacaggagaaagaaacagaggcagagagggaaggagggaatggataccagaaagcaattaatctgcaggagagtagtggttcagaaggtcagaatggagcaaactctctgaaatccactctagaattagcagtagagcagctgatataagagacctacatttttcatgtagtgctctggccccagtttcccccacctcctctctcctatacaccacaatacgaatccagggcttctgtaaggtcacagagcaatccttgcctatctccagcacatacataaaaattcttaccggttcactgtttcacatatattctttatgaaaacccagtcatatcctgtgaggtaggggcgtgtgtgtttgtgtctgtgtgtattttttcattatgcccaaaaactaagatcatatgtcttctcatcactttctatttttgttgctcaggggaaaactgaacacataaacttagaaaagcagtcataccagcctatgaggtccagatgagctaataaatgtcctcttgtctttataatctccaattcctgtgataagatattagggcaataggttttccaaagtaaatttatattctattagcaggtagtgtgtattctacagcttctggatattttgctacaagtaacatttcagttaaattatattctctgggacaggtaattagaggtaaaattgctccccttttgggtacatgcatccttccccacgaatattctcatcaagaggcaaaggtggctggagtaaagtcccaagtgtgttcgtttctaagagaagccgtttagcatatcagaatgagcatgatctttgaaattgtccagatacgtagccccacactagctatgggaccttaggtaggttatttaactctctaacccttattttatcatcaataagtgtggtaataatggcaacatcacaatttaggcaaataatcagtatcccatccatgaaagaggttgctgttgctgcctttaccatccttaacaatatcctctttatttatggggaagggtcattatccatcatcaagtgacaaagcttgtctgccttacctcctagagcaggttcagcagactatagcctatgggggcaaatcctgacagttgtctgtttttgtacagcacatggactaagaaagacttcagctgtaaaaaatcaaaaggagaatattaacatttcataacacatgaaaattctatgaaattcaaatttcagtgtccaccaataaagttttattgcaacacagccacactcattcctttgcatattgcctaaggcaactttcatgctataggtgcagagagttgaatagctgtaacaaaaacccttgccccacaaaacttaaaatatttactattgtgccctttacagaaagagcccgtcaatgccctagccctagagaatacagtatagggaagaccacgtgagaaactgcttcatcacaaataatcagctttgcccttgtgatctttggtgtaggtcttgcatttggaatcagtgtttagtttttatatgtgctattttttaatatgtatggcttgtctctgcattggcagttaccccggcatatctcagtttcagttctgagtgaacgtgttgatgtctttgaggcattcctcaagaacgtctcaaaattattagttatattcctttattcctcattgatcatattataaaccaccttacctataatatgccctcatcgtttgttgaaaatttacccagcatttctacagtggtgtaataacaaagagtctgaaacataattttatgtataatatatgatggttgtggtggtggttctgaagaagaaagaggaagaggagggtagagggaaagaagaggaaaaagattcagttttactcccaatgtggaataatagcaggaagtctgttgtgtggctccaggacattatctcagttccaagctgagtgaaatcaaggtgggagttttctccactaggatactgagaatgaggaactcacaggaaagtaatagaagctattaattgcaggatctagtccttgcacaataatatttcatcacgctatttacctggagccattgcctcaggggaatatagtaattagcataactatcaacaacaatagcatgtatgcataagttaaaacatatgtattttgactagcaaattgtctcactaacaaaagagggttagatgtagtttcttggtgctgcaaaaatgtgcaagcaaaataaacaattattagagcttttttctcctgctgtttataattgaactgagctacaacccatgctttttcccattacaaatatatttatgacctttgttcgttagcacagaaatatatgtcaacatatgagacaactggatacctacctgctagggacggtgacatttgttcttactgctttgcagagtatgcaggtgtgatgaatgtcaacaccctgcgtccttgttattgttaggcagcagtatgcaatccacttgattttcatttagtgtgttggataaattaaatctcagattcttaaacttaagtggcacacttggacccatgagaagtattaagtttcttgctatgcaactggcaattctatctgcttattcacaaatatttgaaaatgcgatcccttgactaagtatttttgcaaatagcaggaggaaaagttggcaagaagcagctttgcttctaagagagtttgatgttctcctttcggaaaagcgatgaaaacctacagtgcccggtgctttacctccgctacctatgccctccctgcaggcagttccaataattttccttttcctgccagcctactttctccttgatgaagttcagtgaatatttaagccttgaggattggggctggagagagggagcattgatttcatcagttgttttggaacacgtgggatcttttctatttttccttttgcatcttttttagtatgataaaaattaggattaaatttatctttctgaggcctgttgctgtttatttctttgactaaaatatccggcaacagtatatcatgaacagctctctttcttaaaattatttcgtaaatattttttgtcgcacacacactggcgcatgcaaacactatttcgtttaatcttgtggtgactctgtcaagaaagggaaatagctttatagaaaaattctgaactaaagtgtgtaaaattaagatctctgtgtttcattgtataaaaattttagctcaaatgaacaaaagacctctcatttttatttttattttagcatttctttaccataaggttagagtaactttttaaaaatatggtagcctaaaaaaactaatgactaaaccttaaagactaatttaaaatttttatcaaatttttttctattattttcttaggaaaattctcaaacctattaaattcaaaagaatgttatggtgaacacctgtatgcatgtcaatgagatgctaccttcatgattttattataaccagctatccattctccatccacccatcaattcacctttatttttgatacattgcaaagtaaaccgcaaatatccatatgtcttcctaaatacctagtctgcctatcattaattagtatttgatatttggtttacagctttttgtttctttgagctaaaatttatataacctgaaacacacagatcttaagtgtccatttcttgagatttgaccagtgcatatttctgtgtcaacgaaatccccagatatatcaagatatagaacagagttatcacaaaaatctcctccggtccctgttaagtcttagttgctttaaatcaaatatcagttcaggttgattttataaggttttctttaaaactgtttagatgcaggcagaatacaaaagatgaaaaagacatgatccctaccctctaaaagcatatagatggtgacaaaaaccaccaaaatagaaaatttcaattttcaatatgttttaaataataacatgtggtagatgctatggaagcacctagcagtgtctgttcatccatctggactctcaggaaagggttttggaggagaagtcagctttagtctggagagaaaaaatgaataaatgttagccaggagaaaagaatgataagagaaattgctccaagaaatagagtacgtattttaaatcagtttctgctgttctagtgtttgggagaatttatgaatcagagcacaccgaggaacttgcatcgtcctctcaagaatactaggaaacacatcacaagaattcattgataaactgagtctctgtaccccaagggtatttccactgccttccaccttccgagttgctgggccccaacttctaagaaggacacttctcaaaccttcagtggctcctgtttgctgctattattagacacattcttcttatcctagcatttctaggtgcctttcatcttcccagtatagtcctaatctgactttgccccacttccccgtttacttacatcttatactcaaattatattaaactctccagtcctcatactttcctgctaggatgcctttgcccaagtctttgcctgtttctggaatcctctctctttaatgtctacctttcataaccccgttcatctgccaagtctttccccctgcccatcagaagccatcttgtctaaaaactcccatagttccttgctcctaccattcccacttttaaagccaaacacagctgttttgttctgctgtagctgacaatgtctagcacagtgctcagcacaaagtaggaaattagtaagtatttgttgaataacagtgagttctatcttatgtcagtgtgtacttatagatctagagtttctctaaagcagagtctgtgttctatacttctttacattcccagaaatcataaaggacagtcaagaattgaacaacattggccaggtgcggtggctcgcacctgtaatttcaggactttaggtggatcactttaggtcaggagttcgagatcagcctggcaaacataacaaagccccgtctctaccaaaagtacaaaaattagctgggcatggtggcagatgcctgtaatcccagctacttaggaggcgaggcaagagaattgcttgaactcaggaggcagaggttgcagtgagctaaggtcgtgccaccgcactccagcctgggcaacagagtgagaccctgtctcaaaaaaagaaagaaagaaagaaattgaacaacattaaataaacctacaatgctattctaatatctgagctgtagcattacagttctatttatatttaatacaaatttaaagaacatgtagtttgaggagtagacctcacaacgtttgtttttgtattagtatacttcaacccctctcttactacccctgaaggcttataaatgaaccgtttggttttaaattttaaaaaggaatcttataaattaagtgcagaaagaaaatgggaaagtccttgatatggtaaatgtttagttttggagagaatatcaatgttatttatgtagtcagtgcatctgttgactgactacctattacatgccaggggctgggcaaaaagcacctgtcctggtgtagcactgtttccagtataggaatatcttacagcagaccccagagaaagagttggactttgtatatttgggccctttgatttgtgtatgagaaacgtattactgagtgaatggaagccttctgattgcagataaccccaattattggaaagttcttctttatagtaagctttgtactgcctctctctaacatcttccagccagccctatttctgtcactggagcctccagaaccaagtaaacccctcttatgcacagcaccttttcagtattgaagatttacattacacaccctacccccaagcctcacctttttcagaccaagtatatagaactcaaaatactttttcaaaggaattggtttccaaattgctgtttgttttttcttaaacattttatatcagttccaacatctgatgtcagtttgatgtcctcctcagtttattctgtaacaggttttgtgatagacaccagcagagggatattgggggttgtggggaagggatgttatagagaagacgaacagagcataatctttgttgtcctaaagtatatacatggcaggagaaaacaatcactttgtcagatcatttcaatatgatgctgcaagtcatgtcagagataagcaatgggtactgtgggagcactcgggtaatctagtccaatctgggttttagggaaagaattttagaagtgtcaccagagttgagtctgaaattatgagcaaatgttttccaagagaagaatgataggaagggagacaatagaagttaaggcactgaggtatgaaatcagtatagggtggtaggggtgggggtaatgacactatagttacttatgtgaagtattagctcgagaatggcagaaaatagggcttgtgaggtatgtatgtatatacacatgtatgcattatgtgtatatgtgtgtctatctctgtaagtgtgtatgtaaatacattctgattttctaattcttagattttgccccaattctcttgttagaaattagaattttggctctacggccaaggactttattcagcatattagcttttcaagagatcataaataatcatcgttgataactataatgacctgaagtgttataacaaataatttctgcgaagtggagttttaggtaatacatatcattaaaggcattgctatgagttgaatgtgtgttccctccaaagttcaggttgaaacttaatctccatcatggtggtatgaagagatgaagtcttttgggaagtgtttaaatcatgagggcatcacatttatgaatgaattaatgcacttataaaagaggcttcaaagaaagtttgctgctttttgctgtttggctcttctgccatgtgaggacatagcattcctccccttcagacgacacagcctcaaggcaccatcttggaagcagagcaaggcctcaccagacaccaaacttgctggctccttgatcttggattttccagcctccagaactgtgaaaataaatttatattatttgttaatgacccagtcttaggtcttatttatagaatcccaaagggactgagacagtatagttataaatcaatgtcaagtttcttccagtttcttaatatggaggtttgccatttgaggatgcttcattgcttctctgacctgaataaagtagcatatatgattctcattatactattgatatttaagggaacggcttacatccatttcataagagttgtgtctcatgaattatttgtattccagaaaccaaactttgtctggagcatcccaatttaagatagccatttgttaagttaattgccatgaatgggtgacatttaataaagtatgtgaatacttaggaacggaaggttgcgaattaaaaaataaaattattctcctctttattcagtttcgtatatcacttaccaaagctcaccctgcctattctatggtgtttgagttcatgcatccagacttgtgttaagaagaagggtgacaaatttagaattcacagtgtgtgttgccatgggaaatacaacaagctattaagaaattgtcttttcaataactttttagtgtaattaaggagatcatgcatatgctcctggaaagagagcctgtagtattgagtactagctaagtgctgtgggctgtgtagacaatgtctgtggtatgcctgcccagtgactgtttctcctgcttttgcaatagcattttaatttttctttggagaactatacctgtcctattttcagcagtccatttgtttttttctgagcatccgtctctgtctcccagacttaaagagatccaggttggaatactcaaaatccaccctcaaacttgtgctgaatctatgtggaaaggagatgtgcctactcattaccatgtttgtggtggcagaatgtcaggttggggttgccagtgaccatgtttgtccccacaaagaagagcctacctgaaaatacagacagcaaaagacaatggatcttaagtctttgcaattatatcagacaatatatattttttcttaggctagttaaagttctccatcacttgaattagtcatggtttattcagagaagcaaccgatacgatgcatagagagagagaaaaaaaaagatacttattttaaggaactggctcatgcagttgtgagggctgtcaagtctgaattgcacagggcaggctggcagtctggagattcagggaagagttgatgttacagtcttggagtccaaaggcagtctggagggagaattccttcttcagggatctcagtcttttaagactttaaactgattggatgaggcccacccacaggttccagggcaatttgctttatactactgatttaaatgttactcacacccaaaaaacaccttgtaacattcatccggactgatgtttgactaaatgggtacgatagccaagccaagttaacacatgaaattaatcatctcactcctaaatgaaaacgccgtggctaatctatgcagtaactactatagttgctcagatgttgcagaaattatcacaggactgatgtagtcaggagaggttgtcaagagaacatactatttcatggtaagttataaaatccatacttttactattttgtaaataaggaatatcttttatggctatgagaaaattgaataagctgatacacatgggaggcacctaaatatttaattttctctcccttttcccttccatttatatatttgagtttctgattaagcctgtgttgtacctgagtctggaactttgcaaggcactttatgttgaggatttatgttttagagattaaatgacttcatgcggaccacgccgtaatctaagggtctagagctcagagtgaccacagcgaaggcactgagccttgtacttattttacaaataggaagctgttctctgtggtgattaattttttaaaaattaagtttcagtgctagtgttctttgccagtcagatgtctacatatgtttctaagtccgtacagctagaaagtgtgtgtcaaataaaagagttgaagttacttagctcctggcctcatatctatttcatcatgctatttaggcattcttttaagatataaaaagcaaaaatatgtaaaaatagccatttctacatggcagagtctgttttaagagcctggccaacactttgggaggccaaggcgggcggatcacctgaggtcaggagttcgagatcagcctggccaacttcgtgaaactctgtctctactaaaaatacaaaacaaaaattagccaggtgtggtggcaggctcctgtaatcccagctacttgggaggctgaggccggagaattgctggaacccgggaggtggaggttgcagtgagccgagatagtgccattgcactccagtgtgggcgacaagagcgagactctgtcttaaaaaaaaaaaagaacctgggattgttagattgttagtatacctgtcccaggtattttatttctaattgggagactagcttaatgcttggaagaatttgatgatgatcttttaaaatgtcaccaaatctaatcactcagccctaaaatacaccctcagggtataacttcagattaatgaggactaagacttgttgggagggctttggagtggaaatttccaccattgttaatttgcaggaggacatgtctgatgtgtttttgtgatggtttcacatctgacagtctgtctcctaggcacctggctgttctccactcggttccttcctgaatgttgcgctagattgtcaaatgccacttcagactagatctgtgcccccgaaagtcatgtgcaacttcatgaaaaaaatctacctgacattttcaaatgcaactcacttgaacttgtaaaagtcaggtgtaaattgagaatagatttgcacctaagtcttctttggttgatttcagtatttgcttggaactgacatttggagaataactcagttgccctcagaattggtcccctgctcactccaaagtgttgtcagggagcgcttagtgtccgaatggctagtacagtatgcttcaggtgaatttcaggcacttttatttactgggtttggaccagtttggaatggaaattaacaatatgtgaattcagtggtttcaccagtgtagcctcttgagcaaaccttggacactgaatcatatttgttgcctaaagatattaatgattatctggcttagcctcatgggcctgattcttcttcaacagtaatgtgttgattattggcattttagacatggttggtattatacagctgaatctctgcacaaattcagagcagctatgcaggcttctgccactgggtgagttgatgaaggagatgatgtctcctctcataatgctgcaccaaacagatggaatggcaagctgtctatgactctgagtatctctgaacatgaacctgtccttctgcctaccctaatcattccactttcacgaagtgcatgcactactgagccacagagaaattacacagcaagcagtagacatggtgcctgaaggcaatgcaactcttgaactggaaatttagcacacatgtgaaatccttcgcagatacaaagccgttcttagactattattttcaaaggtaaaattagagatgtaataaccttatgagatcatcatgtccagttctctcattctagagatagtaaaactgtgatccagaagttaagtcccttacttatggttatatatttagaggaagagatggggcaagaattccaggtccttgcacatcacagtattatccttctaatagagggtgaccaatgaatgcatgatttggtttgtaagcaaatgtgaaatccagagattttcatcatttccaacaatgcaaaaatgttgaatcttagactagaggctctttgacctcttcctggatttattctgtttctctttttacattcctgcaaggaaggactcttgatatatttttgccttgtagaaatattcatttctaagttggtttgaaattagcctgtcatctgattcactgagatagagttaaaataaattcccctggcaaaaaaaaaaagaaaggattttatcatctatatggatcaattccaagagttcgcttcagtttactgatccgttttccctacagtataggatattcaattaaaccttccctcaaattggccatgaattttgatgaaaatgaaagaagtttcgtttagcaaacagtttctatcagggactataataatagaatgcaataagaattattttcacctatgcacctgaacgaacatgttttgtctggtttttggtttgatttctatctgtatctttatttttctctttttgtttttcacccagattttgtgtagcttgtccaaagtggttgagatgtgggatcaggtgaaattgctcatagatacaataatgcttcacaccagtgttttcaccactgatttagtagtgtctttgataaactcttataatattccatacttacatctttctgttttaaatagaactgctgggatatgagttatgtctggtactcccttatttttattaaagcatatatagaaatttttcataccctttgcttcaggccttccttgccccacttagcatctgtagagtggacataggcaggaagagcccactctacaaaatgcatccagtatattttgagtagagactgattatggttactgatcttggtcctggaaatgagaaatgaattagatacagatggtacctctgtggaactttagagcaggagatgaagcaaaacgagggagaagacataagtgaggataacagcacacaaagtggtgagcattgccagtgaaaatgcagtggttttccccccagcgtggggtatcatagatgaaagggcgtttgagctgcaattcagaaggttctgaagatccacttatccaatttgtgttttgctttctctgtgaatggtttgagccagagctatacagggaggtgggcagtggggacagcgcatgcgtagcattttcacaaatgcttcatagggctagacagcagtggtaacatccttagccccaccccatgttttacagatgagataactggggctcaacaaggttaatgacttaggaagtcataaacactctgagctttaagccctcatcttgtgatttctctttcatggctgttttcaggaatccttaattattagattgctgcaaaagtaattgcagtttttgccatttaaaagtaatggcaaaatccacaattacttttgcaccaatgtaaacaggatttttatgatacaagtaactgaaactgactctagataatttaagtgaaaaaggaattgattgaaaagttagcatgagttctccaaaattatggagatcttagccagattcagaggaaagaagccagggtagagtgaaaggtattaggcaacaataagatcaacagcattctcaggaaaacctggccagtagaatgaatgggctctaagctttgttgttttctatctctgtattattgctcaggatccaaaatcagagagaacaatgtctgattgacttactttgaagatgtgccagtggccacccgtttgttaggggagagctaggcatcttgatttacaccctactgtgacagcacccataagtgaagaggtaatgccaccaaaggaaaccagagtggatgaccagcaaagagcatatgtccactgtgggaatacaggcacatgtaggtaaaagaacaaacgaacactgcaagtatccgtatggataaagcaacaaatcattttgtaggcctgagttaacaaatgtgatgtagcatattttcattataatattaagtctatgacaaatatattctgtgctcagccaaagttggtgaggcataacggcacttcttccataagctatggctacttgttcctccttgtgccctctggcatgcagataattaggcaaaatttaaaacagcttgaatgtagtagatgctctctatcaaggtgtgagggttaggatagcatttacccccaggcttaaagtgttctaggacatcttttgggtgagctccctccagaaagaaaaagtgttcctgagaaagggcagtatgattaatcttacctagaggctgaagcacatggtgcatattcacgcaatcgttcatgtgcacgtgaactgtatggaaggatatagctaaggacaaaaaggagttttccagcacaaattgagcacattaggctattatgaaaccattagagatttcttttgtagtttgttccgtatacagcagtctcttgcctgacttttcaaaggaaatgtggtaccaaagtagattccaagggtaagacccagttatcttggttagagtgtcctttcttgatattctcaggaatgtgttcttctggtaatttctgtaagttttcaaatgaaatgggagttactattccaagggttttacaggtagtatctaattcaattatcacagcactaggcaatagttattcttattatcctaattctacagaggacgaaacggaggcacagagaaggtttagtaaattgcttaagatcatcccttgtgcatttcacaagagcagagcaggagtagtctccccttcatatttacgtcatgtatgcctaatatagtacctggtgcagagctaagattgaatgaatgagtacataaattagacatgttatggtacagtatgagtatatattgcaatgtttgtgcatcactgaatataatagcttacatgaaatggaaaaaaactacctagccttttaaaatgtgtttatagttttcatatccattagctcatttgatttttataagacatgtatttagttggagggtataattattattcttttttaacttaaaatcaaatctcagagaagatggaacttgcccatgtgaaacaatcataacagttcctcattataaatgatatagggtactatgggacaaagaaatcttcagtaactttcagtatctaggaatctagaaattccacatattagcatagaaggcccaaactagaaactatagataaaaaataaaaccataaagaagttattaacttaaataaacattaaatgaaagaagaaaacaaaattgtaatcatagttacttgtaaaccagtgataactgcacaatacatcaaaattggcagaaaatgcaaaagccattcttagggggaaaaaacatagccctatatgtgtttatttgaccaaaaaaaatgaaaataaaagagctaagtattacactacaaaatgtgtttaaaagatgatagtgtaaatataaagaaagcaggaaaaaggaaatttgagtctagaaaatctccatataattattagggaagaggagaagagatgagaaaaaagaactaggcttctttccaagattaagttgatctgggctaggcatggtggatcacgcctgtaatcccagaactttgggaggctgaggcaggcgggcggatcatttgaggtcaggagttcaagatcagcctgggcagcatggtgaaaccccgtctctactaaaaatacaaaaattagccaggtgtggtggcatacacctgtagtccccagtactcgggaggctgaggcaggagaattgctggaacctgggaggcggaggttgcagggagcctagattgtgccgctgctctccagcctgggtgacagagcgagacttcatttcaaaaaaaaaaaaaaaaaaaaaaaaagttgatctggaacacatgccctcttatacataataccatttcaagacccctttaaagtaaataacaataaaatagatactagaaattgaaagtacgatatggctctaaaagtaaaatcaatttaaaaaatacaacaaaaatgatttccaatggcagaagaaagaagagaaaataagagaaagaggacaaaacaaaggataaaatgggttatctaatgcagtgacaaaactggcatccttttctggaagaacttcatagggtacaggctggaagagtggttctcttgaacaggcatcagaatcacctgcaggacttgttcaaaaacagattactattcccactcccataaaatatggatttagatatagaccataagattgacttttaaaatacatgaataggttcacatttttataagacaggaacatttacagaaaatgaaatgagagatgttcaatacaatactttaagatgtaatgtatcttattaaaagtggccatagatgacagttgaagtttaagtcttgagaaaactatgtttcttacagaacattaatatacattttccttaaccatctcaacttacagtctaaacactgcgtgagtgatgataggatcaaagataactggagcattgtattaaacatatatttaatctgagtcctcaagaaagtgttgcaatttaaatatatatagacagacatacatatgtgtgtatatatatatatttattaattattaatttgttatttattaattccaaaggcatggtacagagagctgcataagaattctcagctggctttgggaggccgaggcaggcggatcacgaggtcaggagatcgagaccatcctggctaacatggtgaaaccccgtctctactaaaactacaaaaaattagctgggcgtagtggcgggcgcctgtagtcccagctactcgggaagctgaggcaggagaatggcgggaacctaggaggcagagcttgcagtgagccgagattgtgccactgcactccagcctgggcgacatagccagactccgtctcaaaaaaaaaaaaaaagaattctcagctggttaatagcacagccaggtgtacatttgattttcaatatatatatttatatctatatatataaatatatatatataaatatataaatatgtatataatatataaatatatataaatatataaatatatataaatatatataaatatatataaatatatataatttataaatttataaatttatttatatatataaaatttatataaattttatatatttatatataatatataaatatatatattatatataaaaagtatattatatatatttatatattgtatattatatataaataaatatataaaatatataatatatacaacatataaaatatatatgatatatatgatatataatatataatatatatttattatatataatacataatatatatttgttatatataatatatataatatataataaatatatataatatataatatataatatatgtgtttatatataatatatattttttatataatatataaaatatatattatatataaaatatatgtaatatataatttataaataaatatataatatataaatatataaaatatatattatataaaatataaaataaatatataaaaataaatatatataaatatacatatttatatagatagacacacaaacatatatatataggcttttaaaacactaagtgtaaagttctcatcttctttggtagagattagacatctattaatctagcagaatagccaaatgactacagaaaatcatttttaaaatacgctttatagaatagggggaaaacccagtgacataatgcataatgcctggacatcacaatagaatgtattttgtgttaatacattctgtggtttatgcccaacactatgatcagtgaaatctgcctggtttccatccactcagactacactccattgtcatttctgagaaaatagtagcatgattacataaggaaaaatgatgcatgaggatgtcttgttaactttaaggaaggtgctctaaaatatgaatcagcatatagaggtggttgtattgatttttagtattataatttgactctgaagtcacatttgcaatttgcgatttgcaaaagagagtgatatcttgcatcatcacatcagaccacatagtttgcacactttatgtaatattggggaggtagagtggggtggatatttcatcgcaaatgaaaaatgcaacagtttgtttctcgggtgagctacctatggttatttaatgtcacctgccatagcaaaatactgcttaatctatatgactgggtagatgggtgctaaagaacaattctcttttaactttgctgcatgtttaaaaattttgataacaaattgctagggtaagaactaaaagatcacgtagattccagagccaacctaccaaatttaaatttcatctttcctggtatgaccttggacaagtctcttaaggtctctgtgcctcagtttcctcacctgtaaaataaacactcattaaattgtaatgaaatttgagttaacattttcaaagtgcccagaagtgtaactggcatggggaagcactagattatgtgtatgtgtgtgtgtgtgtgtatgtaattataaaataaaacttcaagtcccacagagtggctcatgcttgtagtcccagcactttaggaggccgaggcaggtggatcgcttgagaccaggagttcaggaacactctgggtgacatggtgaaactccatctctatagaaaaaaaatacaaaaaaattagacgggcatggtgatgcatgcctgtagtcccagctactcaggagcctgaggtgggagagtcactggaacccaggaggttgaggctgcagtgagccgagatcacgccactgcactccagcctggatgacagagcaagaccatgtctcaaaaaaaaaaacccaaaaaaaacagaaaacttcacctacaatttggtaaatatccttgtggtttgtttttacttgaaattataggaatttaaattcaaaaatcttttaggactatttaattcaactcttaattccaaaggggtagtacagatagctgcataagaattctcagctggttgatagcagagccaggtgtacatctgcttttcaaattgaaagtcccctaatattgctaacacactagaatttatcttttggcagtggcagggaagagaagttagcagtttttgttattttaacttaattaaatattgtttgatgcttctttttcttttgttttatttgttttttgttttgaggcagggtcatgctctgttacccaggctggattgcagtggcttgatcatagctcactgtaacctcgaactcttgggctcaagtgatcctccccctttagcctccctaagtgctgcacataccaccacacctggctctgtttgatacatttaaataagttaaaatatgtttgaattttcacaactctgactagatgtcatgtgctgaagcatttgcgagtaaggtagcaaatatttagctataatttaagctaatgaaatgagtctgaaaagaatccaataaattataatatgttactattacttcccataagtcattttgatatatggtagaattttaaaaatgattacttgttttatataataccaattcattctattattggttcttttggatgctgagaaaacaaaatatgaatttaaccaattgccttcagggtaggaagctgatcaaatacattatctttaagattggcctgtattatatttcaaagtttcaatgggttaatctcatagttatttacttcaaaatgaaggctggtgacatgaagttaaaatatataattctgagctttactacttaccttgaaaaactaatgatgacaagatatcttcatttgctgatgatacaatggcattttaaaaagaaatggggtttccaacaaaaagtaatcatttacatccaaatacgacttaaaaggtaacccatatggaccacaagaaatgattataattatctggaaagataggaataaaggattaccgtaagagactctgtccattcttggaggggatacgttctctagattttagagaattaggttatctctagctgctgtgcggaagctctgggagataagcaatcacttcagtgacaaaactgtgaagttttaataaaggagcccattggtatgggactgaggctctaaaactgtggcctgatgtcccacatcatgaatattcaaaaccttaaatctggagaccttcatgtacttcctagagaggcaatccattccctcctacccagagagcacgtccatgcacgcaggcacgcgcacgcgcgcatcacacacacacacacacacacacacacacacacacacacactgcccagaagaaaatgataggattttttcctagcatgaaaacattattattctataataagtacacaaatgcagtttttatgttgaagataaatcttttttaaaaaggaaactctccattcctttgtaaaatattgtaataagagaacttttaagtgtatacccaatcatgtatggatgatctcctgtgtcgatatcgcattgcagaaatccatgtacgtattttaatgggcgttgctacttggatcttcagaatacatgatatatctcttctcagatatctcatagaccatcccccctctgctgccactgaatttcatttagacctcggtggctgagtttttaagctagatcgttacaaatgaagccttaccatttgatgaaaatccagcaaaaatgcatattgcatttacaacagacaaaaccaaattttattggtaaaaataactatttcttttagaataaagaatgtatttatagttttgttttgtttttaaatcttgaaagagacctgaatttataattagtacagtgtgattctcaaccttggctgcatattagaatcatctgggggtccttaaaaaatactgatgcgtaggtctcacgcctggttaggatttgattggtaagggtacaacctgtgcaccagggattttcaaagttccctcaggtgatcatcgtgtgcaatgggggatgggaactactgaaacctaatccccgcaattacagggttttatatcgtttgcctcaggctaaagatttatgccagacttctagaccagtctcctttccaattccataaaatgaacaatttcacatattgaaaaatgtttttaataattaatcatttaaattccacaatgtggctgggtgcggtggctctcacctgtaaccgcagcactttgggaggctgaggcaggtggatcacttgaggtcaggagttcaaaatcagcctggccaacatggtgaaaccctctctctactaaaaatacaaaaattagccaggcgtggtggtgcacacctgtagtcccagctacttgggaggctgagccaggagagcccgggagtccagcagtgagctgagactgcgccactgcactccagcctgggtgacagggcaagaccctgtctcaaacatataaatacaaaaaaaaaataagaataaactccaaagagcatgtttccacacttaatgcttattgctgaaaccctcctttgttaacattttaaattgtcgctctatagatgtcattagttttcctcttgaaaaggcactgattaaaaagtaaattattagcactaggtataatattagttcgaaccacagttagtaaatacagaacatgctatctaatgaaaatgtcttatgagcatttcggggcatcactttacatgtgagcaattttggtttttagttgtgcagtctgtgagagtgattttgttagttttgcaggcctcagaaaactccagataatttaatggcacccatcctgtataggatgtgtgtaaagcacttcacaggttgcctatcttggccaaatgtaagaagcaattggagaggcaaaggaaaaagcagtcaggaataatattaactgtgcattattgtggcagctttattctggcttttgttgtattttaatagtgacagctgcacccagaatttcttgtttccataactagtgcaatttccttttcctgaaagctctgtgtagttataacctggtcttttgttttcctgcattgactaaggaaactaattttttttgttactagacagataaaagacaagtgttaaaaggtgtcaattgcattttttttaatatggagaaagtgtccaatcttgtggtctgtcttcaactaattttagatatgattttatttttctggccacccgtggacttgtcacaaattaattaaatgcttcacttcttttatctaattgaggccatttctacctctgatgaataatttcataaagtttgttacaaaggaaaatgctttctgagtgatagtttatgcaaagtaaacacacagaacagctctatttgaacctttgcttgtggcaaaggctttccatacactccacaggaagttgttccctctcaaagaaggccagtgtcttccttttttaacgtacagcatgaaaatgtacttgaccccaagcttcaaagcagagaagtcagctttatctagcagggacaatgcgcattaaatcaataaaatggcaggggtatgaaaccagtggaattgggaattggattccagtcagggtcaatcagcccaaagtagagatctaatattttctgaatgaactgtttgaagcactggccttcagaatcattgtcagtttttgatgacttcctcaggcaacatagtgtcacacacagcaagagggtcacaaacccagatgcctacaggggccggatacagaaaagaaataagtgaagctggctaggtaggagatcatagacagtgatggagactcggtcaggactttggtcagtgcctgggtaatctcacacagtcagcacatagtgagttccagccagtttctgcctcctgggaatgctggagtgttacaaagcctcctgattttttaagagccgctatgaatcttttttcttttaaatgttagaaactcatttaaaatatatgaaagcagacaccagccacaaataggtatttttggagtcagagtttgcataagactttagatatgatatattccaaattccctacttttctgaaggaagaaggagggaagaagaacatcaagaattggaggacatttaggatgatggcaaggcctctgaacgtacaaaaagggggtttccatcagcaccactcttcaaaccagaaatgctaaacgcagagaggattaacatggcagaaggagaattactcatttagtatcacctctttataagcaaggagacttgtctagtcacccaactgctgagcatcagaactgggaccaggcaatactcatagtaaaattagaaaacttgtgaaaacctcagggagaatataaattccagttcattctataataaagtctcaaagaccaccaagggtaacttgtacaagtcctatcattagttagggacagagcctatctaccagttgtatatggtacaaatatttttgagcatatgaatatgcaacaatttttttaaaactcttccttcattatattaagactttttaaaaaatgttatttatgggatagtttatttatcagagggctgctgggttcatctactctggctgctaatgacagatgaatcaccattcagcatttactgaatatacattcattaaaaatgcagtctatggaggctctgtagaaatatggaaagttgttatcagtgcaaaacttgaaataaaattgtatgcacattgttataactatttttatagttgaattgcaaaaacttggaagggaaaacaccaaaagtatctgttaaagaggtgaaattagaagtgattttttaaaaagtcttctgcattattatatggtgatattaatttcaatttaaaaatatatagccacgaaaataaattattacttgaacaactattgaaagtccagcaatgtgctagttgccatagggagataaaattctattagctagtatagaggagaaaaggtaacatctttttctcacccattgcagggttcatgattaagatccctgtaacagaaaaccagattaacaacagaaaagcatacagatttatttaatataagttttatggaatactgaagcctacagaaatgaagacctaaataaacagggtgtaatgttgtaaaatatatatttggtcttcatgccatgtcctggcatatgatttctaaaatctttggaatctccaaagtgctgtttttctgtatgctaatgttgactgaccacttcaagatgggtctggtcaccagaaagacaaagtcatgcttagaggattggtactttcaaccccaacctttggggaaagaagagggactgaaggtcaagctgatcaccagtggtcactgtcttaaccaatcatgcctatgtaaagaagccttcataaaaacccaacaggacagggtgcaaagagcttccagaaagctgaacccatggaggatcctggagggtggctcacccaagcagggcgtggaagctccacgccccttccccaatacctcgccctatgcatgccttcatctgtatcctttgtgatatcctttatgataaccagcaaacattgcgttcccctgtgttatttgagccactctagcaaattaattgaacccacagtgggtcatgggaacctcaacttgaagccagtcaggcagaagttccagaggcccaaatttgcaactgatatctgaagtgggggagcagttttggggactgagtcttcagcctgtgagatctgaccaggtatattcaaaatgatatagaaggacccccaagtggtatctgctgcagaattcattgctcacttggtggtgggaagaaaccccctcccacgcacacacatttggtcacagaagtcttctgtgttgatgattgctgtggtgtgaaagcagagggaaaattgtttcagttttttctaaacacaaggaaaactatttttatgtttacatttgatgaagagtggaaagtcgtatagagatatgattgaacaaaaaggggcatgatctaaaggaaataaacgggggaacttagcacggcctgtttgttcagcttctccttagagtctctaccttcattcctttcctctggatatagggaggacccctctggaatgcaggtcttatgacctactttagatgaaggtcagaaaatcttttatgtcctgcttcaggggagaaccacaggaggagattagaaagaccttcctgcttctgctgtttgctgaagtgacaatatgccatattttggggtagcgtgtcctgaacctaatcaataggctcacttgtaaaatgagaatgttgagagataatgaaataattatagaaagaaagaaatctgaaatgaatgtacaaacaataggctttagattctcacagacctggatttttgttctcagctctgtcatttaggcatattgccttgggaaaggaacttaagtgttcacaaagtctcagatttgtgatccgtaaaatccagatgatgataataccttcatcatggttgaaatgagacaatgcatgtaaagcacttagtgagaagcctgtcatggagacatggccgttaaatgttagctattttcactaccattgtggattttatccttctacagaactagtaataataatcataatagcactagcaatctagtaattatagtagtgatcactcattattgaaatgggctccccctgttggccaggcagtgttgggacttttatctgattgttctctaaatttcacaacaatttttttaaaaaaatcagtattattaataaatattattcagtactatttataaagcaggtgagactcagagtgtaagtaatggttctaacatctcatagctagacatagaggagctgggatttaaattcagacatgtatgattccaaacagttcttcatactgttctgtagaaaaatctatgtgtagccctaggaaatgatgtgactttatataagcaagagcaagtggggaagtgttggggttggagatgtttcactggttgggttgcctgggattggatgctatgccaaaaaagaacctaagagtgaaagaggaagatagcacctgtggagtaagccaggctgccaatgccaaggaacccatggtccaaagaccaaaccaaacaagtactcagccccaaagacaaggcaattataggcaagcagtactcaatgagaaaaccaaccagaacagaaccagagacagccagtgggagcttactcagcctgtgttcattcccgtcggggttgggagtggtataggaaaatgtcgtcgtttatttatgtatttttatgttattttggagacagggtctcgctctgtcacccaggctggagtgcactggcactattacagctcactgtaaacttgaactcttgggctcaaacgatcctccttccttggcccccaaagctctggggttacaggcatgaggcaccacgctgggcccagttcgagagtattcataacattggttgggcaacttgctttggaaggctgtactatcttgctttatctgagatattcaagtgcttttaagatctttatcaactccaattagacttcaacagcatttggcagctttctacatatatcgtgtttcaaggttgttgatatctcttgtttttatctatggtagagctttcacttcccttttacattctacttgttgctttagggtgatctccaccaggaaaggaatcaataattcgctttatgtacccagtagaaaactgtatgtttctaaaaaccttctaaaggaagcagctactgaaaaacaacataataaaaggaaaatgaattgtgaaaatacatatgtaaagggataaattgtatatgtaaaggaaagtaaaagccaggagcctattttacattatacagccttataatttggaaatttcttcatagcatcattataatgtgaggcagtatggagtatgattaagggcatggatttttaaatcagcaacctctgtttaagtcctacctgttactttagcaaatcagttgtcttaaccctttatgtaaaaaagggaatatcagggggatttatcttacaaaattgttttaaggattaagtgagctactctatgcaaagcacatttcaagtccctgtcttagtcagttagagctgtcataacaaaataccataaactgggtagttcgaactatagaaatttgtttacttagagttttggaagctgaggaatacaagatcaaggtgccacctgacttcctttctggtgagggctctcatgctgacttgcagacagatgcctttttgccgtgtcctcacatggctgagacagtgcgagctctttggtatctccttttatgaagacagtatcatgtcagacaaaggctctaccccatggcctcatttaaccttaattacttccttactttagatataggcatactgggggtcaggatagcaacatctgaattttaggtgaacacagttaagttcacagcagttcacagccatccccattacatgttttaattttatttgtttatttctttttcgagaaagggtctcactctgtcacccaggcttatagtgcagtggcatgatcataactcactgcagcctcaacctcctgggctcaaacgatcctcctgcctcagcctactgagtagctgagaccacaggtgtgcgctaccatgcctggctactttcttcactttttatagagatagggtctcaccatgttgccccagctgaccattttttaatataccaattaaattcaccaaacatatacttgtttaaatttaactcaaagatataacttctattaacatttcttaatatattgtaattgagataaagcacagcattatcatatatcattattgtatattatatgatatatctaatattattatattattattatgggatttatcttacaagattgttttaaggattaagtgagatactctatgtaaagcacattgcgtagtccctgtcttagtcagctagagctgtcataacaaaatactgtaaactgggtagttcatagatgtatgattatgtatgtgtcatgtatcatgaaaatgatttacattttctcccattctctgtggcccatggcattttaaggacttcataaaaattggctataattattatttttattggagaagagatacactccatatgcctcttctattaaattttaccattttagtagttttaaaatgtataaatcagttctttttagcatatacacaattttgtgaaactatcaccactatccacttccagaatatttccattacccccaaaaagaaaccccttaccacctagtagccctttccaacaccttctttccctcatatactgggaactactagtctgctttgtgtgtctatgtatttgcctattctggacatttcttatgaatggaattatgcaatatgtgaccttctgtatctgcttctttcacttctcataatattttcaagattcatctctattgtcacatgtatccttttcatggatgaataatattccactgtattgatctatgacatttgtttatccattcatcagtcaatggacatttgagctatttctaccttttggctattattaataatactgctatgaacacttgtgtaaaagtgtttatgcagacctgtgttttcaattctcttgggtattgtgcaaaaaagagttaacaggcctgactgctgcgctttgaaaagcctggtttaaaaggttggccctttattggcatgtggaaacctggatttcagtagggtgcccactaccctaactggtaagagtggctcactgttcctaaattgtgcaaataatatggttttttatgaacaccttatttccttctgggaatctggaattttggtatatgtcaagcagaggctgcctacatgaccagcccccagtgaaaaccccgggtactagtctttaataagtgcccttggctggcgttttcacacgtgttttcataattcattgctgttttatgtgcatctcctgggagaagacttgggaatcttgcctctgatttcctccagtcttcactccatgtgtttcttccctttgctgatttttctctgtatccttttacattatgatctaataagtcataactgtgagtatgaatatatgccaagtcctgtgaatcctcctagtaaaacatcaaacctggggttggtttcggggactcctaacacaagtatatacctagggatgaaatttctggatcaactttttgagcaactgcaaactgttggccatagtatctacactattttacattaccactagcaacatttgagccttctgacttcatgtaatcactccaatacttgccatcatttattttctgggtttttttgttttggtatttggtatgtatttctttaatagccagtctactgggtatgaagtgctatctcatttgatttgcatgtctctaatatctaataatgtggagcatcttttcatgtgtttattgaccatttatacatctctgtttggagaagtgtttattcaagtcctttacctattttttaaattgagttgttttatcattattgagttgtaagattcttttcatatgttgaatactagattattattagatacatgattcacaaatattttctcccattctgtgcattttaagcacttcaaaaaatttggctataattattatttttaatcaatgatccttcaaatcactaggcttttctcattgaccaaaatagcctcatatatattatcaccatatgcatacattttcttggttttttttttaaccctttaacgtttgctatgttgatagcatactgatttctctatgttgggaaagtatatttcacacattttggtaattatctatggaatatttataaatatctctattatgtgctggatattttgcccagagtagaagcatattaactgacaagggccaactcctgaattcccttttagaaaatgttaacaactgctcagatcctacttcaggatgcttttcgtgtcaagatcccaaaggtttgataaagaatggttggttttcatttgagatagtcattacccagacaaggttggttatatttcacttaatgtttttatggcttctaacacaaccagtagttttctatttatttcctgggagtagggaaggatagttgtgttgcttgaagtgtattttttattatttttgctattaaatgagaacaacaaaaattcactgtaattattaactttctttcattttcacatttatttctgtaatttctcaagtccctgaaataccctgaagagacttatctagttaaatagttaatattttgttgtgaaagttttactataagccaaacattttactttttgtttttaaagtaaatgtagacatatgcacattcatatgcaaaatgatgggcccaaattggatcagggatttttaacctgaaatccatagattatcttcagggaggtgtctgaagcccctgaaattgcatgtacatattaactccccccatctacttatcaatgtgttctctaatttaaaaaatgattaagaactactggactagataagtcttagatctgtccagattaggttatttttaaaaattcagttactaaccatcagcttgtcagtgaagatatgttcaatgaaggaagggagggaccttgtcaatcttttttcactattgtatcctctacatgtgaaacacggtacgtactcagaaaacatttgttgaattagtcaatgaatgaatgattaaggaacaatttctccatagagtgacctaacattagaacattagaaacaaggttcataaggacaagacttcacttttttttttttttttagacagagtctcactctgtcgcccaggctggaatgcagtgtcatgatctcggctcactgcaacctcgcctcctgggttcaagtgattcttctgcctcagcctcccaagtagctgggactgcaggaatgcaccaccatgcccagctgattttttagcagagacaggatttcaccatgttggtcaggctgatctcgaatttctgacctcaggtgatccacctgcctcggcctcccacagtgctgggattacaggcattgagtgaccacgcccagctaatttttatatttttagtagagacggggtttcaccatgttggccaggctggtctcaaacccctgacctcaggcgatccgcctgcttgggcctcccaaagtgctaggattacaggcgtgagccaccacgctgggccaagacttcacttttgaaatagaatgaaaagttaatttacatagaaaattcaaaaattgactttcttggtgggctaagcctcagctagttctctcaaagaccttccagaagaaccaggttctattataaacaatagttgacaagtaatcaggatatgtagtgttcagccctagttctgctatataccagcttattctacattccaagttgttttgtttgttcattaactcattcattaaggatggatcagatatccacagtgtggcagaaagaatgataaaagctggggaacaatgaccacattaactcaagtgtctatcttctaagagcttgcaagcaatagacaagtaagtaaagtattataagtgtgactagggtaagtatcatggtgtacagaatgctttgaaagcagaaggaaaggccatttcattatagggaattttttgttgcctgacaaaaatacagatatttcctattttttgctacattacactttgcttctttttgatgtcaatgagatagagatgccatgacatcaaaagccagaaaccaaccaaagggatttatactgcttttataccctattaaatgcaggtagacattacctaccctctttccagccctgtctgaaggtggctttcttttatagtctaaactattctgagcctgaacattgagcataactcgttcagagacctggggaagattaaaggtaggttttctgggacttacacctgaatttttatgtacccaactgagccatcagttttgggaaagagagggcaaaggtggaaagatgtgcttgctcactttattactctcctagaggcaaaaaatttgtgtccatggtgatttatgttcaaaaagatcttattccatctagaccacagaaagtcacatgtgtcttcctatctattagataaacactaaacagaaacaagggtgcattctccttcctatgccaaacacttcccctcccccagcattatagactttaaagaatttaaagacattttgtgtttacatacttgtgtaagaattattaggtgccagaaactaatctcagcactttaaatatattaagggatttaacacttacatcctataaactgggctccatttcacaaggaagttgaggcacaaagtctaagtaactcactcaatgttgcatagtggtagagctgagattttgaacccaggcactgtggttttgacccctatagcttatagacattagcatattctttttttgtttgtttgtttgttttgagacagagtcttgctctgttgaccaggctggagtgcagtggcatgatctcggctcactgcaacctccacctcccaggttcagcaattctcgtgtctcagcctcccgagcagctgggattacaggcatgtgccaccacacctggctaatttttatatttttagtagagatgagggttcaccatgttggccagactggtctccaactcctgacctcaggtgatccacccacctcagcctccccaaatgctgggattacagacgtgagccaccacgcccagccaagataattggtttagaatcagttttctaattctatctgcatcccttaagagagagaaaaagaaacaaatcatggtagtggcagagtaaccaaggcttttggggcctcactgtatttgtcattaagttaggatgcagaaataatacctgccttagcttatacagtgtgggttggggaactctgccatgaacatggaagtattaagcactgacacatgatatactgatgccactgctgctatttcatgtccggcattgctcttcctgcatatggtactgaaggcacacctactgctgtgtgcatatgtgagtgtgagtgtatgtgtgtgtgagagagagagagaatttgtttgttgcaaacacactaagcaccctcttactgctacagggctctgtcagttactgctgtttttgcctgtagtgcttatcagtgatagcctcagggtttgcctgctcacctccttcaagtcttggatcagatatccttttctcagaaaggacttcactgtcaactctatttgctatggtctgaaagttttgtccccattaagttcatatgttgaaatcctaaccctgaaggttgggcctttgggaagggattaagtcatgagggcagagcccccatgaatgagattagcacccatgtaagagaagccccagagagctgcctttcccctttgctatgtgaggacacagcaaatgggtgccctctatgaaccagaaagtgggcttcaccagacaccaaatctgccagcacctcgtgcttggacatctcagcctccagaactgtaagcaataaatttctgttgttatgaagttacccagtttatgttattttgttaaagcaacctgaacagactaagacgctatttaaaattgcagtgttcttcctagattctctattccctttcttgatatacttaacttcacaatacgaatgacctttcaacaagctatgtaaattacttaatctgcttcccacagcctagaatgtgagctccttggacagtgtgtttacttctctctgtctatcctcagtgtgaatagtctagtacatagtgggtactcagtaaatacttgttgaatgaatgaaagatgttaatccattatcccctgtcagttacttcttacttagttgacatgtttctcaagcaagcagatgcttttgcaataaaggtagagaaggtcacagtcatccaccttctctgtggctagaggtgtatgggaagggatttgaggatcatttgatagcgaaatgaagaggacaggtggatgacttattcaaaagacccaacaactcaatggacgtgctttttacctcatcttaagaaagctaagaaaacgtttttttcctctcttttgataagcctgtgaattcaagtcaatggcattttttctgctgccatttatcctttcacagaaagggtttttgctttgtgtttgcccaaatcagtgtgcatgccactttaccttatgacaaaatgacatagaaaaggcagaatgcccaataattggtgcaaattttatgcttgtcattttgaaaggttataaatcccctcttttataatgttttctatagaggatactttaggacagaatatcccttctgtacatcaatatgctgctaattccaaaaaagaacaactttgtaatttgaaagaattggtaacaagtgtggcatatgatgaatcacatttatccattctgctgtctattgaagggaaatggactttcacttgtttccttctaaaccaaagtttcaagacataaatattgacaaaatagattatctctcttcctaagggatgattccatcattctttcccactatatttctaggtaaaagtggaccagttttactgttatccaaacaataaatgggaggaaacttcaggtactatgaaaaacatttcatttttaattggaaaatcaagattctggtgagagctccatcactgcgtatctgtgtgactttggatacaccacctaatctttgcaaacctttgtttactcgcctcaaaaagtggggtttgataaaaatctgaactcactcacatttaatatgccattttactcacagccttagtccatttgtgctgctatcacaaaatacctgagactatattatgcataaagaacagaaatttatttctcactattctggagactggagagtctaaaatcaaagtaccggcaggtttggtgtctggtgagggctgctctgtgcttccaaggtggcaccctgttattgcgtcctccagaggggatgaaggctgtgtcttcacacggtggaagggacaaaaaggcaagagggttgaatgctgtttgaagcctcttttatgaaggccttaatcccattcatgagggaggagtcctcatgaccttatcactctcctaagggccttacctctaaatactgttgcgttgaggattaagtttcaacataaattttgaagggggcacacacattcaaaccatagtgctcagcgtaccagaatctcatgtgttacttggtgctggtaatcatagagagcagttgccgtagtgtatcataatgccagtaagtacttggctctgatcttagaagaaaccaagttcagtccctgttctgcagcctcttataacggtggcctgtctccaggcctctcttttccatcattaaatgaggaagagcatagctcttgtctgtgggttatatgaaccagcccccaataaccatttttactttgtagagagcctaaccttattatgtactcagtaaatgatggttattattgtcattattttacatggctctaaagaggatacataggggttatcttttgaggaagggagagtcagagttgatttgtagttttgtaaacactcttttttcaaagctgagcaaatctctgcctaagttgaatgattatggctttgtttatccttctctgacaggactttctagtttcagtcagtgggtaatgtagaacatatgtctggtttggatttcccgacaaactttcaattaaaataccaatgtcccaccaggaagaaccgtatctggagccccttacctgccataaactttatctacattgtgttctcattcccaacttcactgtagacatcatgatagccctatctcctaagaaacaatgtgaaaaataattaaaatagtttcacaccagaaagaaaagcacaccaaactcaaatttagtggacctgttagaaatatgttctccaagttttgcttgagtagctttcagattactccctttcacgcttcctagtatatatattgacgcattcactatgtgccaaattacaaacctgaaacatttagagaaagacagaagtagggtactttagctgccaaagagacaggtgcaaaggctcatgaatattagttgaggagctgcggtgcatataacatgaaagtactgcctgcaggcattctgtgattgggcagtttaatgtcagtgggaaacggagggtgtcactggggagttaaaaacaacagcagttcaccccagaagggcttaaaacagatagtctccaggaaactgtgaaattatgactgaacgtagaaagggcaacctctccactttggtcgtacttttgtttagatgagaaggaggatggtttggctcttgggagcgttggagagatagctggggaaagaaacggtggtttctcccagtcccacaaaaggttggacaactctggattatagtactcttaatacatgacaactaaagcgtcagaagccaaagcagatcttctagatcatttatacctcctattaaacagaaaaatatatccctatgagcatggataatgggagacactgttcattcagagcataaaagagaggcatttccagcatttgatttcagagccatgcaagtgctcttttttccttggttatcagctctggcagccacctggtgcttaaaacagcctgatgtggttgctgaaattacccttctatgccctccttaaatagtggctcatgattgtagatcacctgcatctgtaacccagggtgcaacattctaatgcatatgcctgcaccccgtccccaaatctatgtaatcagaaagtttgggaaaggccacggaatcctatagtcctcatttttaactggctctctgggagattctttatgcgtagaaagaatacacaaatgcatattgaaggcattagcactgcttttggttaacggtcttttcaaaaggccaccattaaagtgtatgaattccagcttgaatctaacagtctccagaatgacttagattgtagttatatatatttttttacaacaagaaactgtcctgtagtggggaagggcctggacaacacacatgatggagttttccatatgcatccagaaataccagaaggggtacagttcaaggaagcagatttttagggagtagttgatcccggtggtgttcaggttgaagtacagacacaaaaatgaacagtaagtccacagagagaaggcttttgcctgccacattgctgaagaccagtcttacttgtatgtattcacacacacacaagtacatttggagaaatgtcaaaaagaaataagaatagaacgaagaccaatgacatgaagaaataactcactgaataaattggtgtgtacctttctatgcatatagtgttgatcaggagtttcttaggtacagctgataacaactgcaactcagatttgcttaaatgaaggcaatcattagctctcatatctgagaatcttagggataaagcttgcttgggacggaacttgttccagagctgaaacgatgccatcagaactcagtctgtccctatcctttaattttgctcttttctgttttggcttcattctctttttaggttctctctctctatgtgggagtctttggaagctccaggcttccttctgtaagcaattctagactacaaaagggttttttccttgtagttttatgaaaagtcctgcaatggagtctcattagccaggctttggtcacccatgcatgggaaccaatttaaccaagaaaatggaatattaattggtcaggccaattgataatgtataaataagtattaataacttatcaatgctaagcagtgtcatctgctactcctgacctgtgcagaggattttagtctatccaaaccacttgagttgaaagagtaggagggttggttcaccaaagaaagagtagaatgctcttacctaatgaggagcagtggatactgaggcaaaaatcacagatgtctactacatagttatgccagtagggaagcaccattgagtgaattagtgaccctgatatctcatttacatttctctagctaaagccaatcaattttatacatgtatgtttctatgcttttattctcatgagtaaacagtaatgcacctaaatataaatcggaaagtttgctgcagtggagcgctgggttgttagggtagtacactactctgtgtgatattgtaatggtggatccatgtcctaatacatttgccaggaccacagcatgtgcaatacgtgatggaccctgatgtgaactgtgggctttagttaatatgcatgcattcatattggcttatcgattgtaacaaatacagcacaggaatgcaagatgttaacaatacgggaaactgtgtggagaaggagtgtaggcaaactctctgtgctctgctccatttttctgtaaacctcaaactgctctgaaaaaataaagttctattaattaaaaagatgaagttagctataactattattagtcctctctagagtaaacattccatgagggcaggacaatgtctgctttgcacacggttatgtcgcctccatgtaatattggaattggaatccaatctagtcccagaaactcggatcagaagccatttgggtcagaaatgtttgagaatttaaaatgtttgtaattttagaagagaaatatagcccacaaaacatgcccagtgttacataatagcatccccagctgagtctgggtcagcactgcataatcaaacgcatttctaattctgcagcaaagcatatgaatattcacattgagtctataaatagtctcccatcagttcccatcagttcaggtcagtttttgcctccaaatgagttacaaagtatttgcatttgttggaaatgcttctttcttgtcataactagggcttggcgtcagtatcacccaattacttatttttaaaagagtcattaatccattgttcctggaatgtgtcaaggtttaagatcagggtcagagtaggatacattgatacagccccacggctgttcttttccacgcctaaaaatcctcgagcaatgcacaatttttccccaaggagagaccctttttagctcccagcacttccccgtcctaccactgtttctaagatctggcattacaaacgattagggcttcattatgtgtgggacaaatgcatgatggcggcagcattattttgttaacaagagaacaaagaaatcgtctgagaagagttcacttctcatttggatttttttcactttgtgccttcagacatacaccagctgtcggtagacttctctgtttcttgctgtttaaaatgctcatttgaggggttaaaagaaggaaggcggaagcaatgacaaatgaaagtaatgtttatcctttaagcaggcatgtctgtctcctctaatatttgctttgcctctgctctattcagctgaacaaccaaatagaatacttattcaatagaaacgctgtgtgttggccagtttttcaagtaggcacttgggtaaggcctttgaacatgccttgctgtctgtcttataaatactaacaacactaaattgtattagtaatgatagtgtgacagctgtccaatcatcatttctacaatcagtgattgaattttaaaggaattcttgcactcaggaaaatcactcttacagtatttcatttgtttgtgaatttccttaggttattgcccatacgttttatgagtaatttagatccacagagatgctgctgatcttacagttttttagccaaaatgcatttccctaatcattaggaagcctggaggagaaggttcacagccagcaggacacagtgtgccctacgtgtgcccttcttggaacatgctggtggtggaaagagtaatggttcttcccattgggttcccccttggtgtgagtggtgagggagaaagtgaaatatgagcaggacactgagagcacacccaacaacccagcttagcagaacttccccttccttttccctggtgactttgttctgcaatctgataaagcaacacgttcccactgattacacacacggagcatttactctcttgattggtcaagggctctgcaggatataggcaaagccactctggtttgcaccaggttacttctgtgcatgcataacgcaaaaagctacctaccctccagatgtgacccaggtacaactcatatctaaacccatgcagtcttccctggctggtattctaagcttctattcaagcccttgtgttccccattaggtgtcctagagtttacttcccaagtgaaaattgttgctcttgaagtgtttctacccaagaccaggtgtttaatcaaatagcccatttgatgtcatgggaagattgactgtatatcacagtgctgggttcttggctgttatggcagcacttcatacctgccattaggattaagggcttaaacaagtttcaggtgcaacacctgggaacaccacagcaatgacaagtagacttgaacctggaatttgtagttttctaagatgaaatcataatattgcatttttgttctttcccaacagagtcagttgaatttgcaacagatggaaatacttccagcaaaagaaaagggtgctgttctaagggtcatgcggcgaaatgtggccttcatcccacggagtagccgcagagtgatctagcacatagaacagaactctgcagggtagtttttcttcactgggatcctaacctgtttagaaatgaaagtggccgggcgcggtggctcacgcctgtaatcctagcactttgggaggccaaggcgggcggatcacgaggtcaggagattgagaccatcccggctaacacaaaattaacaaaaaattagccgggcgtggtggcaggcgcctgtatttccagctactcgggaggctaagcaggagaatcgctcaaacctgggaggtggaggttgcagtgagccgagatcgtgccactgctctccagcctgggcaacagagtgagactccatctcaaaaaaaaaaaaaaaaaaaagaagagaaaagaaaaatgaaagttgtctgtgctcaattcataactagttttaaaactttagaatgcataggccaggagcagtggctcatgcctgtaatcccggcactttgggatgcgaaggcaggcggatcacaaggtcaggagttcgagaccggcctgaccaacatgctgaaaccccgtctctactaaaaacaaaaaaaattagccaggtgtgttggcacgcgcctgtaataccagctactaagaaggctgaggcaggagaatcgcttgaacctgggaggcggaggttgcagtgagcagagatcaagccactgtactccagcctgagtgacagagggagaccccatctcaaaaaataaaataaaataaactttagaatgcataaagatcaagagatgcttgctcaaatgctgttttctgagtcctgataattagaatccagtaggtctgggagggactcaagaatctacctgttaacaagcactcttagctaaggtcatagaggttcagtatcccttatctaaaatgcttgagactggaggtgtttcagactttggttttttgtggggggtggcagtggattttggaatatttgcatatatataatgagatatcctcaggatgacacccaagtctaaacatgaaaatcattaatgtttcatatataccttatacctatagcctgaaggtgatttatacaatgttttaaataattttgtgcatgaaacaaagtttatactttgaatcatctagcacaggtgtcactatctcatgttggcactcaaaaagttttggattttggaacatttcagattttggatttttggatgagggatgctcacctgtttcagccgggaggtttcttgacacactttgagaaataattattttaggtatagtttgacttacctttttactatgttgctttctatgaaatgtttattttgagattagatctactgcctgacttggtccagctcctaggattgttcacagatgccctgtaaaaataaaaataaaaaccaaaaaactacatttagcatcagtggaattttcctagctccacccaccctctagcttcctgctttatgcgtgttatctttttttgacctttcccttggaatccagattttgttctgtacttgctcctgtgggcttgatatttgggcatctgcctcacttccttgagttaaccatcacctgagattcaggcttatttttctctgctcagcctcagcccagccccatccattcagattctcttgcccagcctcgcttccagcagcctgagtagtatcctgcttgcctgggagggaagttcaggaaaatgtggaagtgggccaaattaattaaaagaaaaaaaaatagagatcattgatgttccaatacagcaaataaattaagtgacacccggctgcggagaggtgctttattactctttttcttagagggtttttttttttaagtcaaaaaatattttgtttccattacagatgtggtcatttttattctgtaacctaggaaaataatattaaataatattttctaatggaaaattctatgattctgtgcatctctttcagtaatccaaaaatttcagattagcccagagacactatgttttacttctgggacccttgtttctggtcatgaaatctgtgcttttttctgataatccaaagatttcccactccttgttgaagcatgaaagcagattttttcagcctagtcttctcccttccctttatgaagatgggtttatccatcctaattcaagataattaccgtggtatggaactttgcagaacactggtagtctgatagaagttagcctagtgactgattggcaggtacctagttaccaaggagaaacaaactcaggaaatcatgaaatcatgatgtaacagtattggtgcctgcactagatcctccaagctgtgtgtcagatcaatggtctggaatccacaagactgtaggtgagctcttggcaatcttactgctcactccctcattcctcattcctcctcttaacatgatttttaggaattcctagaagggtggaaaatcattgccttcccctcctctaataatgtgagcccatgcccctaatttctccaaggcagatgatgccctggggcgactctcacccttttggggacccaagtgtaaaaacattaatcccaacatcctgtcactcaaataagaagacattcattacttataaataaatggtagtggttacagtataaatgctatgtatacaaatgaagacaaactataactataggtcagtggactattgtgatctctaaggatgcctgctctttgtcaattcagtgcagtgcttgttggggagggtggtgtctcacaattagcttctggagttcaactacaagtgttctaagaaagagttagtttatgtcagtcctaggccttgacacattcatgtgagtcagttttataactttctgttcctggatgcttccctctcaactattagtccaggcaggcatgtgctaaaattacctctctaaatcttatcaagcaaagatttgttggttagactttgcccccaaaaaaatgtgtctaggagtgggtctaaaaccggtgttggccgatgttctgttcttaggaaatggagagccaggaatagaaggatctgtgttagtagttctcaaacttcagtgtgcagaagaatcacccagagagctaggttaaagggcagattaatgcaccccagattcttctggcgtagtcagtctggactgaggtttgataaaacaagcatggcatgataataatgcaggtggtctacagtctaactcggagacgcattgtattattaaatcttgtcctctgtcatttgctgcgatgctctttacctctttagactgaaaatcacagccactcttctggttacatagaacaacttactgtgataaaaaaaaaaaaaagatgaactttatcttctaggctttgaaaacggtaaatgcagtcttttgtatgtgccttcaagacacttgaaagtcactttgtggctgccacacagagatagaacaaacttagggatgcctctccccctgtttcatctcagaacgcctctctcaggactctttgtctcacccaggcacctcaaggttttggtgaaataaagcagctcttttttctcaaaaacattgttaaccctggtccgaaggtttaaaagctaggatatctgggttttttttaataccttgatagctaaactttctaaaatttctcccttcatctttgtgagcccaaatagctcgtgcacaaaagcctgtggatttccttcgatgagaactgaaatactattccctttatgctaatgttaattttcaggcagtgagcttggttaactatgagaaaataaaaactttagatggaatgcattatttatagtgaatgcaaagcatcattattatcaattcttgttacaaaatacacagaaaaaatatctttttgttatttaaatattgcatggctacattgagaaacagtacagatgttaatccacagtctctcagctgcatcctgagtaatcattattacgttttattcttatgtggaataactagtaatagactctatatttctgtatgaaattcaaatcagggaacaccaatgaattgagatgattgatattatatatacacacacataattttggaattggggacaacaatggaaatatttctctcttagagaaaatccaccaaacttgttgctttattagtgatcttgacgaataacatgtttcatttacctagatgtgccaaaaatcacttaattctttaccattgaagtgagctcacatttgaccagtacttaaatatgttttgaaaatatctgtgtaattgttaaaaatctgaaattgaaatgtaaatatctggattttgaaatatccaactttaaacacaaattttttttttaaagtgcatgtttgtgtttttttttttttttttttgagacagagtctcacagcatcgcctgggctggagttcagtggtgtgatctcggttcactggagactccgcctcccaggttcaagagattctcctgcttcagcctcccgagtggctgggattacaggcacacgccaccatgcccggctaatttttttgaatttttagtagtgatggggtttcactatgttggccaggctggtctcaaatgcctgacctcatgatccacccacctcggcctcccaaagtgctgggattacaggtgtgagccaccgcgcctggccatgtctgcgtacttttattccatgattttattttgtgtgctttcataaatcttctcttttttggttgttttaactttttattgatgtggtattttataaatggagtaaggagagacagtggtagtggtgatatgattcatgacatctttgaatgcaaattaaatgtgtaggtacatgtgtgtttatgggaaaatattcctggctgttttccctgtctttgttttttgttgttttgttttgttttgagatagcgtcttggtttgttatccaagctggagcctgctggcaatgatcatggctcactgcagccttgatccccccagatcaagccatcctcccacctcagcttcctgagtagctgggactagaggcgcatgccaccaagcccagctaattttttaatttttggtagagatagggtctccctgtgttgctcaggtttgtcttgaacccctgggctcaagcaatcctccacgcctcagcctcccagagtgctgggattccaggcttgagccacgatgcccagcctgttttcccatttttaactgataaagaatcactggcctagtctaatcttattgatttatagatgaaacacttcaggcatgtagagactaggtgattttcctgaggtcctggagttagtatttgacccaaggcattgaaactcagtccatggtctttctgaatcctcacccatctctttctcacaacaagatcgtgggccgtcctcagtccccagtaataagatagaattctgtttggtcattttgtcttcttaacttttcttctatttcaaccttagcatgaagtgctttttttttttttttgtctgagttaaatgttaaatgccttagaaattaccttaccaggcttcacctagatccccaaaccaactttattcttttttctcagcactgatgcacctgaatgaattcagtctcatcctatcacctatcaacaaaaggctggttatgaagtttttccaggatagcagttgcaattcttgcccttcaaaataatcacatataaggggactgccagttgcagggtgatatttaatataactttacatcatagcctctggtgattctatcttaaaactcatcaggcagtgcctaagtaagctaattgaatacattaaaaattgaaaaaaatacttcaaagtaaagcagattcttattgatcaccgtgtgttatatataccactgtacttggtaccacaagagatacaaaaataggtaagatacagtcatgctttcaaagagcttataatccaaacaagggaaaataaagtgtactctatgttaggtgcacttagtagaaaaagataagcgtcttgggaaatatagttttaaaattatattaaagaaaaaggttgagggtctagcagagtcttccaggaaaaagaatttgaacttgattttgaaaaacgaaaatcacttccatgggcgtaagcggcgagatgcattttgaacaatatttattgtgtgcatagtctagaagcatgtgtactcgacactgccacttaaggtatggtttgtggatcattccagtctttgaactttgttactgctccgtgacaaaataagtctcatgcatccagtttctcttattgagagaaagcacttagaaatgcatggctgtttaacatggcttcaccatccaagcacataatcagtggactcaaatcattgcacctgttatagaccagtttgggcgttactgagtcatctgtggtacaggctatgtgacatttatgcaaggtagaccatatatggcttcataagacgttgggaaaacaaagaacctagtccttcgctgcagataatgtgagaataaagactgtaggttgttctttatttgcatacatagtcattttgaggaagtgttgtgtatattagcaatacggagctgttactcattattgacttatttacagtatcgtccttgcttctttctaattttatcatctcattacagcacagaaaaaaatgttagctttatgacactagacagccatccacaatgacagtagcacaaaagggatacgggaagcacaaagtaaaggggtaggctaaagacaagcagaacaatacatagaagagagaaagggagacgtcaagcagcctgcgcctggaagttgttagtaaaattagtgaccaatgtgaaataagagggcttatattttcacttcatcataatccacagaagattaaccttcaatgggaaattttcttctagaagctgaaacacagcctgttgtgccttactattttttgttaatttctttctattattttccttatgttgttgtttcctgttgttgttcctatttggaagggattcttcattttggacattttctcttctcatttcagatgattccacactgcatggcccgatttttattcaagaaccaagtcctgtaatgttccctttggattctgaggagaaaaaagtgaagctcaattgtgaagttaaaggaaatccaaaacctcatatcaggtttgttgatgtaaaagcatgtgtttccatgcatatagtttctgttattaaaatcaacaaatacttatacaatgctggttacataaagagcttttatttatttattttattttattttattttatatatttatatttttgggaccgagttttgctcttgttgcccaggctggagtgtaatggtgtgatctcagctcaccacaacctccgcctcccaggttcaagcgattctcctgcctcagcctcccgagtagctggaattacaggcatgcaccaccacgcccggctaattttgcatttttagtaaagacagggtttctctgtgttggtcaggctggtcttgaactcccaacctcaggtgatccacctgcttcagcctcccaaagtgctgggattacaggcgtgagccaccacacccggaccaagagcttttatttatttatttatttatttatttatttatttatttagagacggagtctcgctctgtcaggagtgcagtgtgcgaccactgctcactgcaacctctgcctcccaggttcaagtgattctcctgcctcagcctcctgagtagctaggattacagatgtgtgccaccatgcccagctaatctttgtatttttagcagagacaggatttcatcatgttgaccaggctgatcttgaattcctgacctcaagagatctgctagcctgagccttctaaagtgctgggattacaagcatgagccactgtgcccagccatatttttatttttcgagacagggtctccctctgtcacccaggctgaagtggattggctcagtcttggctcactacaacctccccctcccgggttaaagggactctggcacctcagcctcctgagtagctgggattataggtttgcaccaccatgcccagctaattttggtattttcagtagagatggggtttcaccatgttggccaaactggtctcgtattcctgacctcaagtgatctgcccgcctcggcctcccaaagtgctgggattacaggcatgaaccaccacgcccagcccgtaaagagcttttagacaggcatcatagatatcctgaaagtctaaggagatgattgtttcctgaaaagctaagtacccaacctctgtttttcgtagtgctgggaattaaatatcctgattgactttctctttgaaaacattaacaattcataaccacatatatttaacttaataaacatattttaaactatatcagtaaactggcaggaaagtaagaaatgtcagaagtctacaagtaagtgggtttggaaccgaaagaagtaagctgaacaataaagacagttttcatgttaataaactacaagtatgaattgagctttggttttcatggcttcagagaacagaggtcacaagacaaagcctagacaacccacaggagaatccaacatgagaacatctcccagaataaacctgggatacaagggctacatctttacagtaaatgtgaacaagaaataagcttgacttccaaagagactcaaaagcacaggtaattgtgtctttcaaacattaaaccttagtggttctagtagcagatgaaatacaaccgaaaagaatttgtaaactgcaagataggtctgaagaaatcctccagaggcagcagaaagagacaaagggaagcaaaatactttaaaaagaaagagagaaaaaatgtctactcaggattccagaagaagcatcaagaaagactgaggcagaagcaatatttaaagagaaggctaagaattttccaaactaattgaaactttcaagccgtagctataggaagcccaatgcacttcaagcagtacaaataaaaatgaagccacatctaaaatagtgaaatggtagaacaccgagtcaaacagattatcataaaagtaaccaaacttgtaatacagatgacattcaaagagatcacaaactggcagctgacttctcaatagcaacaaaaaatcaggagacagaagataaaatattcagtacagtgagagaaactgtcaaatgtatggatagcctaaatacttcttttaaagcaaaacaaaataactacatttttaggcagacggcaaccaaaatctgactccagcagaccctcactaaaggaaattttaaaagacatacttgaggtggaagagaaatgattccagatagaagagctgagctacaagaataaataagtaaagcaaatggtaaatgttagtaattccacaaaaaaatttattgcacagaacaataaaaataataaaaagaatactgtcttgtgaagataaaaagaaaagttaaaattcatgacaacattagaaacaaatttttaaaagatgtactagacaatggattgtctatatggttaaagaaataaaattggaaccctactgcgcagcatacacaaaaatcaattccgagtgtatagaagacctaaatgggaaatttgcaatacttttaaaagcagatgggtttacatatttatgactttggggaaggaagagattttctaaatatgacagaaaaaatacaacttataaaagaaaatatttaactgtattaatattgaaaacttatgttcaatagaatatactgaaataaacaaaattacaagctgtaaacttgaagaagatttttaagtatatttgttatgggtaagggattcatatccagactatttaaagaatttccacaaacagaatgtaaaaaacaacctagtggaaacattagctaaacactttaacaagtatttctaggaaaatgaaaaccaaaaattcagtaaacataaaaagattgtcaatatcattagtgaacagaaatatataattaaaactacaacgacatactctttcaaaactaccagattgacaaatttagaaaactgacaatctgttggtgaagatgaagagcaaacagaacccttgattgaacactgctggtagcaatttaaattggtaaaagccattaaaaaaaaaaacactccctagtaaagctaaaggtgcacgtactctatgatccagtgtatatgattatgttcatagtatattcacaaatacacataacctggtatgttcgtacaaggtaacctcatacagtagtaaaaatgaatgaatgacagctgcaacaaatgggtagatctcaagaacataattttgagtaaaccagttcacagccaaatgcatagtatgtaatttcatattcataaaatttgaaagtggttgagatggagtggttgttcaaggtatagaggaagtaacagaggaagcaaaactttacccctcctctcttaggatttttcagctaagcctgagaattaaattaacataaagcagatcaaaaggagaaaaacatatttatttaatacaagttttacatggcaaggaagccttcataagaaaatgaaaacccagagatgcagttatcgttgcacatttatttactgaattggacaaagagtagtaaattgtgaaaaagtaactaagttatgtggggagctagaagaaaatattttaacaaggtctggacagagttttctctgtctcaacttcctgtccttgatggaaagaacgttactttccttctaatatagaaaggacatctttggcatggggattttatccttgctttttagaaaaagaatgaaggtgaaagtggtcgtcttgtacctgctgttttccaagtacctttttttttcccccaagtacctttaactcaaaatagtcaatataggcagggcacagtggctcacgcctgtaatcccaacactttgggaggctgaggcaggaggatggcttgaggccaggagtttgagaccaacctgggcaacatagcaagacccccatctctacaaaaataatttaaaaattagttggccatgggggtgcacacctgtagtctcagctagtcaggaggctgaggtgggaagatcgcttgagtctaggagttccaggctgcagtgagctatgattgcaccactacattccatcatgggtgacagagcaggaaccggtctctaaataaataaataaataaaagtcagtatgccagagcagcatatttttgggtggcatgctctgaactccttcaaatgataacatacatgataaaattataaagaatatcacgggaatggaaaagccaaaattaaagattataattaaccattaagaaggagtggtataatcaaagtagatacagcagacttctaaagtaataatatcacttttaaacacagatcttcattggcttatgatttttataacttacatacatcttataaatattatgcctctattcaaatttgataatgaaaaactttaacaactactatctaatattatgtaaaaaacaaatatatatgtcatagtttaggagagactggagtcatcaggtagggttctcagaagaaatgggatatgaactgagataagtaattttcaaataggcagagggtaaaggacattgtattcaagttaaaggacggcagtattagtatagtggatattattttagaatttactttacatgctcatttatccatttgttcatttatcaaacatattcattattcatccttcaaacctcaccagtgtttttcaaacagaattccagggcacatggaattggcttaaagatcaccagagaaagaaaataacagaattttcatccaagattcagcctttgcagctctactttgaactagcccatatattaggattctgaaaaatacgtcatatagacaaagtatttaaaccactctattaagcagctgcaatgtaccagtcagcatgctaggtctgagtattcaaagattaatcaactctacaacatgcttactagtactgttaatttgaggactgcctagatgtggacgtagttggagtagaatgatgtaactacaagtaaaggatgaccaagttctaggtattctggaggaaagaaagtctaattcaggatggcgaaggtagatgtcactgaagtcttcacagaaaaggagatattttaatatatttggagggtgaatggttctttcatcacatggataaggaaaagaagtgcattccagaaagtaagaaaacaacaactctctaatggaccatataattagggtgaacatgtaatttatcatctgaggtcactttttaaagcagaaggccgctgttcataattattctaggacagcaggtgtaaaccaagcacttgtcttgggcaagccagaatgaatagttactctccctagaatatattaaacccaaggctaaatcaaagatttttaaatactttgtgtagtaaagaatgcaggaagcaacggctgttaggtacacacatgatgagttaactggtccttgtttgccttgcgtagccaagtgtaaggtcagatgttagccgtaaatgaaaacacattttgcagcagaatttggcaagtgctgctttgttttcccccaaactgtgacctttaattaacattgcttttgtaacactgtgtttctagatataggagtttgccttgttatttaaagcaagcagtgaaacagaaacctattatgtttttagatttccaggaaacactgagaacaaaactttttaatcaaatgcactagcaatttattgcagtatacttcttgcctttatgcctttggcagtgtctctgtaacataatagcagactggtacctgggagctaaagcattcctcttgttgaaagaaagagcaagacaaagaatggagagatcaagtattttcagacacctttctgcctgaactttttcagtcttcaggctgaatttgagggggaagaacaagtagaagaaattccgaagtgagtctccatggggatcttcagcactaggttctctcctcagacaccgcaactgacctctcttctttgtgtttattccctcaactgagccttctcttttcattgtttcctgcccctcaattttgaaaggattgacccagacccagaaaaatttaagaagttttaacttgtgccaacttcccttatattaaacttccctaaggacatatgacattacttaatgcactcagcatccctttccagatagaagaaatgttcactcacttggtcggagtacttttgctgaggtttgtattcaactgagttggcagaaaacaaattccaagtcataaatgccctgaccttcccttagtgccaagttgacaccatcaacaaagaaagaggattttgctacagcgaatcctatagataccctcccagcaaagccacagcattttaccctccagagtgtcacagcatcggtgtttggttgtgcacaaccccactctctggagagagtggagtcgtggttcctcaaatgattcagaaatcagcttatgagactcacaaatttctcttgtcccttgggaaaatctctattggctccaaatgagcattgcctctatattaccaacacttaaaagattcctcacacattgaaagtaaattgtgaaattttcaagcgtgtttcagtatacagtgagataagaaattcagtgcaatccacattcaattggaatgaacagtgactgcattgcaataaaacttggtatagcgctttgtaatagagactcaactgcatttcggagaaagcactttattttctaaataatcccttttcgtttgctatttgtatgtaaaagcaggcgataaagtagattaatggactttctgcacagcattttagttgagatgactagtgtaggaaaacctacagaggagctctcattatgcccacaaccacttttctaaaaagactcacatggccccactcctaaattccacactctgcttgcagctcacattatgttgcgatttcctttttgagttcttagatttgtcatattaaattgctctactatcatttgaagtaagagttatggtcaagacgtgatcagctgactcaaaaaaaaaatgtctagggcagacagtcagttctagagattcatgtgcacatagagctgctagaatataacctggctgttctgtctttattatactttcttgtctgtgtcagagcacagagaattactgtggagactaaaaacattgtcagtttctaatcccaatcttcttatatacaaacacataaagaggtacctcatgtttctatttcatgctcctggtctacctttcttacctctcttgtttctaaattgttacatttcaaagacatgaataaacatgtgttgctatgtggtagtgtgctggaatgcttcataaattgtggatgttcaaagctaaaatatccagcaaagaagtgaaatatttagttaattaaattcaaccagcatttatggagcacaatgagagtgttagattttagatggctaaagtgagaatacaaaagtgatttaggtaaattatctacagtaaaagcagcattcctacataaaggagcatggacaattccgtaggagattggacaaagctttggttaatttttgttgtttttgttttgagatgaggtctcgctctgttgcccaagctggagtgcagttgcagtggtgtgaccttggctcgctgcagcctcaatctcccaggttcaagtggtcctcccacctcagcctcctgagtagctgggactacaagcatgcatgcaccaccacacctggctaaattttgtattttttgtggaggcagcgttgtgccatgttgcccaagctattctcaaattcctgggctcaagagacctgcctgcttcagcctcccgaagtgccgagattacaggcgtgagccaccgtgcttaatcatctttggttaattttgactagaaatactaaggaagacttcattgaaaggggtgtcactgcaaaatggctttgaagtgggacagaggtcttgacaaaaagaagggattacccttctgtatatttgcttttgttgataccagacatccaaaatcttgaaactaactcacgtacatttttttcatgtaaatccttttacattatgtacagacaaccacagtacccaagaatgttataagatgatacacagtgaatgtgcatgtgcacacacacaaatatttaaatggtgatttttactatttaaaggagataaggttaatggctctcattccttactctcattatggatttggatcagttttgtttgtgctgctgtatctcttaatttttaacattctggtgtgaatgctgctgtgatactcttggtaattcacaaactcctactatgctattttcgttagttaatattctgtgtaagagttgtgggggtaaacgaatcggatagtgactgagttatattagtgcaaacgttctgaagtgtttaaatgacttctgaaaggagatttggtcaagagaagctctcactctttggaatggtattggttgtaaaatgaaataaaaacaaaaacataggtcttattaccaaaacttcgctgttaaaatgtgtgggtcccactaaacctgctttactgggctaaatactctagtcacatacataggtgatccaggtagataaacagaaggacaaaaaacaaaaaacctgtctttgccccgataacctaatagcctaatctgcagtttgctgggatggttgattgatgtttgtgtgccggtggtgaaggagctcttcaaagtgatccacggttaaagcaggtttggtccccacagcagctcaagatcaatagttcctctgctttgcagccagccattgcagtcatattaaggaccaaatcaaagcaactctgctgcaatttcatcagatacttagcaatctacctggaaatagtatatgctgtcatctgtatagacctatttaaagaatgattgcaaactagaaggacttttactgaggagccccatttgaagaaagctgcacaggtgctatgagaaatctgtggcccgccttcaaaacagtgaagtgtttgtagcatcataagtagtcagaagaacattttaatgatattaaaaaaattttaatatcattgtttactttaaaagacatgctctttccatataagcacttaagatgtcaccattgctgggtagagcatttctaacttcttaatcatgctttttacaaaagtcacaaatgatttttcatgctatttatagtttttatatattttagacaattcagaaatattgattaatatgacaagactttatctactggcatttttatactataggtggaagttaaatggaacagatgttgacactggtatggatttccgctacagtgttgttgaagggagcttgttgatcaataaccccaataaaacccaagatgctggaacgtaccagtgcacagcgacaaactcgtttggaacaattgttagcagagaagcaaagcttcagtttgcttgtaagtagcaattatacaatgctgcaaatgttgctttcagtttgtgtaccattataccaataagcttttatagcagtttcattttagagactagattttaattggttacatgatcatctttactctttttcacattttggaaacaattttatttgtaggataaactgtaaatctaagtgagaagatgtattcttctacttcgataaggattgagatagttgattgtatgataatttgattatatgatgctttctttatatacaaataaattcacacactgagattgacacatgtataaatttatgtaaacaacaaatttgacacccacacacacccacacacacacattttaaatagaatgtgtataagcaagcaattgaacaaattttacacacacacacacacacacacacattttaaatagaatgtgtataagcgagcaattgagctgccagtaatttagtagagtcaataagagaaatactttaacgataaaggtgagagttggaaaaaaactcagtagtcaattaatcctacaattctctaattgtttcctatttcacagagttgaaaaaatttaaagcaactgtaataatgacaaaaacatggagacaaagtgttatccacctttgatatttccagcttaaaatgtttaaaaaaacaaataaccgtgtcttaagaccaccatttaacaaaagtccatgaatatatgaaagaaagtggaatttagaaatcacaatttgaaaataaaatccataggcaagagcaattagcatacatttgggtatagccacctttgaggattgaggttcagctacatttttaagggtttatgtatttgcatgtgattatatatttccttgtgtgaaatcccaactcatatagcagtgaattttggcattagccaaaggtttcataaagtctgctggcagtaacactgtagaatattctcattaacaaaatcctctccaggaactcaacatccaatatacctaatatccagttcctaatctattaatgccatttggtggcatttttataagttgggaaatgaattttctaagtattatgtatatgcgagattccaggattattctgttagtgaatgtctcttgagatagtcttctaaatattcgtaggtgtttagaataataggagaataatatgtgtgattgaatgtaacagaaccaaagtgtttctttctcttggtttaatacaagtcttgtatctatattgattttttagtaatgacaaatcttgctaaattaatttttggaaataaccataggatcatgtactctcagagtacgggaaaatctcattatttagtaaatcttgtaattctttgaattttggatgtcatagtgtaggaaatgtttaacacagtataacaccaaaaaaaaaaaaatggagatggaaatattgtatctgggccagcgcggtggctcacgcctgtaatcccagcattttgggaggccgaggcgggcggatcacgaggtcaggagatcgagaccatcctggctaacacgatgaaaccgcgtctctactaaaaatacaaaaaattagccgggcgcagtggcaggtgcctgtagtcccagctgctcgggaggctgaggcaggagaatggcgggaacccgggaggcggagcttgcagtgagccgagatggcgccactggactccagcctgggcgacagagcgagactccgtctaaaaaaaaaaataaaaataaaaataaaaaataaaatactatacccaaacttctttattgacagcttacatttaaaaaaaaaaaattaccagctcttaagattatccttttgtaaaagaccgggcattttactaccaaaacatcagaaagatagaatctcatattcaaggacagtcatttacatagaatagtttaaccaaaacaaaaaacaaaacaaaacaaacaaacaaacaaaaagctctaccactcagttcgtggtgggttgacctgaggacctaccaggaaatggaatccactttgctcattccacttcatgtgtgatgtaggcattcctcccaccctcaaaatccttggctgatcatcatttggtttgaaaaattctagtgacagaaagttcaccaattcatcacgaggcaccctggcccacagcagactgctctacttgttcaaaaatacaaaaacaaacttgacatctctttcttaaaattgagccaaatatctcaatttctatcacattcactcccaattcttactttaaagatgctggttactcttcaaatatgtgaagatatgatcatgtcccttgtcccataattcttttcttcccaattaattaatccacagccatcttcttcacaacacactcaattatgttaattcatctattgcagccttatggaaatgcacagaattccatatatgtgtcttaacttttgcaaaggacactggggacagtagtatctcatgatgtgaacttttttcagttaatgaagctgacaataatatttatttaatcttcatttttaagtaccagccccagattgcaactttattttaaacatataatcatgtaaaatctgagaaagtatttcttataaattcctattcatccagtgctacccaaccacgttgttttattaacctaaattcagaatattgtatttacccctaataaattcatgttctgagtagtgaccctttgttccatcatatctgaaattgctttaagtcttttttttcaatcagacataatgattgttctcctagtttagtgtcagcagaaaatttgataagcatatctccattcaaataattgatataacatgttgaccaggacagggcagcatgtcactagagaatttccactaaaatgaaattaaacctttaatttaatattatttggacactcttgttcaaccagctacaaatttagccaaatatactataatcgaactccaatttcatccacgtgtttttaaagtagtgagaatctttgctaaagccttgctaaaatcaacatgtattgtttctgcaacatccagtcctacctgctccgtctgcatcgtcttgagcctttccttaaccatttatcctaaaactgccagagtaatcttttaaaaaatgtaaattagatcattccgcttccctgctttatgccttctactgtacttagaataaatctcaaactcattaccatggtctcattttaatttctcaaaaatgacaaactattttttgcaacaggatcttgatacttttgttccctctgcctgatcagcttttctcatgatctttcacacagctgacttcttatgatcctcacttctcaatttaggtatgacctcctgagagaaagtttccgtgtcaccctgtctaacataacaagcaatttccatcatttctcctcctctctgctgaccttcctccagccctctacttttacataacagtatcttctatttcacttaccagaattttttgtttttttattttttgagactgagtcttgctccgtcgccctagctggagtgcagtggtgcgacctcagctcactgcaacctccacctcctgggttcaagctattctgcctcagcctccaaagtagctgggattacaggctcacaccaccatgcccagataagttttttttttttttttgtatttttagtagagatggggtttcaccatgttggccaggctggtttcgaactcctgatctcaagtgatccacccgcctcagcctcccaacaaggtgagattacactttgcccagctcatttaccagaatttaatacaatctagaatgattgtgtatttacttttttctcatttattatttcactcctatggcagaacgtatattttaagagaactgagactatcttgtccatccttttatttcctagccatttatatgtttgaataaaggaattcctgtgttacgtgcctgttcagtaacacaacaaagaaaatatatgtataaagttaatttgagggtgatgtatttttatatacccaaacccaccctttctattcttgtaattttctggagtttatctttttgatcattgatccatagtttctagatgtttttccctatcttttgtaaattaaaagaaaatcaaaagacattgcctatattcagaattcactttcaattgattaggataaaatccttttcttcagtgaattaataaaagtgaggcaagacagtgacatcttttgaatgttactagtttctttgactccacgtattgtcatactcattgaaggaaaaaaaaatgttgctttttggccacacttactgcactataccatgcaagtgagaatatttcttcctctttaatcatacaattttatggttaaaaaagacattaaaggtctcctggcctgtatctttttaaaaatgaaattgaagattagagtaacggaattactcattgttaatacatagttaagaagctacagagccaaggaaaggcagtcttcagctcccagtttcatgcatgctggccctactttgctttagatttactctaatttatgagaaaaacaaccttcactttatttaccatgttacaattttcaaatctcatttacatactttctataattttattcagaagatagtcttataaggtagacattatttctattgattattaaaaatgttttcatgctgcttttgtgcacagaacttagtcatgtcttgtattagcatttagcatttttaagttgaattaattcacataagcaaaatttatagctaactagagatgagaccactaagaacttgctcttcctcccactttttaaagtcaatatatttaaaatagaaatccttctttgattaaataaggatagcataatttaagtcccccttgatgagatatggataagcatacattattgtaatgtaattgggagcacattttgtttttcagtctctctgcagcattaagccatcagcaatcactcccctcactgtcacttagcctactaccataccctttctaccttttagcccttctatttcacctagggctacaaatatgattgactagatcctctgtgcctggcacttaataaacttgaaataatggttgctgaatgaataggaattagacattaaagtcatcatgccatgtgtggggcataaggaatgagttgaaccactgagtcaagcacgttctgatggtcctttggagtgaattggaggtgagagcaagcattctcaccttgaggttgatacagaagacagttgacatcttaattccttataagtgtttctattggtgtggcaggcgttggcccacattaaaaggatgcttatggccaggcgcgatggctcatgcctataattccagccctttgggaggccgaggcgagtggatcacgaggtcaggagattgagaccatcctggctaacatggtgaaaccccatctctactaaaaaaatacaaaaaaaaaaattagccaggcatggtggcgggcacctgtagtcccagctactcgggaggctgaggcaggagaatggcttgaacctgggaggcagagcttgctgtgagccgagatcacaccagtgcactccagcctgggcgacagagagagactcagcgagactccgtctcaaaaaataaaaataaaaaaaataaagatgctcatgtatggaatgaatcaaacaagccctcaaagttcgcttttaccctggaaagtcagcctgagactacgcacagcttcatgaagtgtttcaaaggaaagctcctttgagcttaagcatacctccccaaccttcattcactctacactccctttcgtccaggagcaaaaccaagttgaatacttcaaaaagttcttccatagacgaataaatcagaagataaggcctaaagaggaggggatttcagttcgttatttgcacagcttaacgaaggggatgtttccagagcttgtgtctatacagaatgaagtgctatagctccatcaccctagctgcccacttttgcagcccagcatcccggtctaaatctgcttgaggatctttgtgcacagtcactcaacacagcaacttttctctgtcatataaacactgatatttattttaaaaaaataaatttcagtacacacccctacactcataaacaatacaaatcctcatttttttttaacttaggaatgtgggcttgagaagatgagatgttatattgactaagtttagagggaatcaaatgtcgttaattgttccatttcattctatgtgtcctgtgtctctagaactccagcttctcaataccactacacttcccttttaaggttgttagcaagattacattgtaaagcatatgtaaaatcccagaatcatttccaacataggaaagttatacaataactgcttctgtgtttttttgtctgttctctcttccattcccctttctgtccctccatgtcctgtctttttaaaataactatcacttacaaaaacttaattgactcatagtaactgcatgtatttatgggttacagtgtgatacttcaatacctgtatgcaatgtgtaaatgatcaaatcagagtaattagcatacgcatcacctcatgcaactaaactatcatttctttgtgttgggaacatgcaaaattctctcttctgaaaattagagtaaattggttttttgttgttttttgtttgtgtgtttgttgaggtggagtctcgctctgtcacccaggctgcagtgcagtggcacgatctcggctcactgcaacctccacctcccgggtccaagcgattttactgcctcagcctcccatgtagctgggaatacaggcgcccaccaccacgcccagctaatgtttctatttttatagagacagggtttcaccggcctcgaactcctgacctcaggtgatctgcccatctcggcctcccaaagtgctgggattacaggcgtgagccaccgtgcccagctgagtaaattgttcttaactgtagtcaccctgtggtactagagagcacaagaacttatccctcctatctagctgtaattttttgtctgttaaccagtctctccctatccttcttcctcccttccccacctctagttaccactcttctactgtctactctaattctgtcttactaaataagaccaacttatttagcttccacatacaattgagaatatgtggcattcgtctttctttgcttggcttatttcagttagcataatgtcctccagattcatccacggtgccataaatgacaggatttcattctttttatggctgaataatattccattatgtatgtatacttcattttcttgatccattcatccattgatgggcacttaggttgattccatattttggctattgtcaatagtgctgcaataaatatgaaagtgccaatatatctttgatatattgatttcctttcttttgaatatatacccagttgtggaattgctggatcacatgaataactaccattgtatacctaagtatagttgataagagcacaagccctggagtcagactccttggattcaaattcagcttctataatttcgtgagcttgaacaaggtacttttttctgccccaggttgtttacctcctttgttgtgaggatcaaatccattaataattgttaaactcctagatcattgtttagcaaatagtcagggcataataaatgttataatgtgaatactctatgttggatattatactaagcactttggaagcattattccatttagttctcaacacaacccaatgaagcacagatattacttttattttataggtgaagaacatgaaaattaatgatgtgaaataactttcaccaaggatacagcagtgggagaagggaccagcataggaacctggtcacctgagtcttgagcagatgcctgttatatggcattttacatgcatggcttcccttatgctgtgaaaaactacactttaccagtgaaatttatgttcaatccgtagatttgggtggttggtgaaatgtttcctttgtacacaaacttgaattttttgttgcattaacaatctttgatatagtaagtacatccatcatatatttgcttttgtttttaattttttagttgtaggtattcttgatgccatcatactgttgatttactgtgaacatctaaaagcataatgttacatgcaatgactatacataaatttgtggactctaattttaatataattggtttcaggttttataatgagaataattaataacaatatttctgctctaaaagttaagatgcagatttccaatttattgcaagtaggctgtaaagcattttgaatattgatattttatggtgaataactggttggtaaactgtttatccccaagcagtaaatgaaatatttgtataagcttcttactcccatatcatttctcccctacatgtgagaaagatgaactttaaatgtagattattatgaagagcttcccagagaataatcttaatatctaatgactccagattttagcctgtcaaactgattactttataaacattgtttggggccttcatcctggaattttcactttcttgtagtagttcagatctgcaaagcaaaagacttaagctactcatcatctcaggctgtagatgactgtaagtcatacataagtacttccaaattgctaatggtaaaattaaatctttgaacaaaatctggctacctgcctgctgtagggaaactggcattatcatggtcatgggcaaggtggtattattctggaggaagcaaatgggtgatatctatgcttacctctatggatacctcacttaagatgaggaaagtaactagactaatacaccattcatgccctacatctctaccctctgagcatgtgttaaggggaagggcatagaagatgaaaagtatttttaaaaaatggaaaaatggagatgttaagtgaaaggagtgcttacgtacaaaagccacttcattttggccttcctgtgacttcaagcaagcaatctatgaataaagtaactcttctgctgttgcggaatgaagtgaaaaaaaaaaaaagaaaagaaaaaattttaaaaagagagtaatgtaacacaataaatcactccattctgaggttaatttaagttagccttatcagttaagtggcaaacattttttatggtgaaaatatcaattgaataaacagcaactgattagatagtctcattgaaaaagatctttcttatgactactacagcgagccttaatctgagttctctttaactggggcacactctgacaactgtaatgatggtggtggtagtggtagtggtggtggtgatagaaaactttattaaactgagaatgtattgtattctcactgggaattttggcaacctgatttttgagcccagatccttgcttctattcacggtaattttcaaatgttcattgcttttaatatctaataactagcttatccttcatagccaatgagtaaaatgtgcagtcgatcagaacagtagctgggagtttgatacacggctaaactcataactggcctgactactttttaatttggaaagctgcttaaacaggcaaactttttttctgagcgataaaatgtggatggatgactatttagatgaataatctgtgaatatttagatcaactgaaatgtaatcaactttagaaacatttgggtatcaaaagtaaaaatatttttcaatggaaggctttgatcttcaataaaagggtaaatacttttattggaataggtagaagaagtcaaacccaaacttgctgagtttctgaaataatgatagtttctgccactgagtatagtactagacagaaagacattaatggtgataatgggtgtctattgaaaatttcacaaggtaaatcttaggagctattaaagtacagatgctagttaattgtagctattattaatagtttattatgtatactttcttttggtcatcccacagtccagtttggggactgataaaaagcagtttgtgacataagacaatcaatgaagtatagagattgctttaaattcaagaaggttctgagagtatgatatatatatgaaaattggcgaatgaaacctgatggggatccaagcaagattcatcagacttttaaaaaacatgaaggctaaaagagaacaattaatattttgtatcaccataaaaaaaccaaggtactaaaatatcactcctttttgtttcgttgttatgagtaattcagtcaacaaatattaaaataattctgatcatttttaagtttaatttttaggcactgaaggtcaacattcatgtgttgccattcggggaaaagggagaccactttctgaatgattgaaaatgtcacaattgctctaattatatcaatatccttttcttcaagaattttcatttgagaggttatggtgctgtagtacatatattttcacttgtggttaagtcagaatctaattgactaactatagtgatttgaatggtacctgctatagactgaatatttatatctccaaaatgcctatgttgaaatcctaaccccagtgtgatcatatgaggaggtggggcctttggtggtgattaggtcatgagggatctgcccttgtaaatgggatcagtgcccttataaaagtgattcctaagagctcccttgctccttctgccatgtgagtgagaaggtggcagtcagtgaaacaggaagagagccctcacaaggcaagaaatctgctagcaccttgatcttggacttcccagcctccagaactgtgagaaatacatttctgttaagtttcccagtctattgtgttatagcagccctaacagactaaaactgtaactctcaaaaaatgtgtctacctggaaactgtgaaagtgaccttatttggaaaaacggtctttccagatgtaattaagtagatgacatcttccaaaatcacccagatggaccataaattcaatatcaagtgtcctcataagagagtgaggagaaaacacaggagagaaagagactatgttaccatggaggcagagattggaatgatccagcaggggaaaccagtgattgctgaaagccaccagaagctagaagaagcagggaaagattctctcctagagccttcgaaggtgcccagcactgctgacaacttgatttcgggtatctagcttccagaactgcgagagaataaattttttttttaagccattcaatctgtggtaacttgtttgcagtggttccaggaaacaaacaggccaacatatgcacaattctttttcatttctttcctgaccactttgatcaattttttaaaaaaatctttgaatgagatcaaaatcaggtgcttttgtaacttaactgtattagggtgaaaagtattaaagaaatggcctctatcaaatgtaggattatctgtgcaagttttgtctcacactatgcattttcccctggagagcataacagagttttgaactttataaagtatgatttgaccagataatgaaatggggactgcaaaaaattcaaagggtaacctttccctttcccgggtatgtttttacctctcacttggaacagacctctgcaggccttctctgaaataggcagaattggccctttctccatagggcaatgatttgaagtgatgcggagtagtttgttggccctgagtcccgctctctggacttcttccgttttctaggtcattttccctgaattcgacctctttgtctggcactctaaagccctagaaactggctattatcacgtttagagtgtctgacctacctgtggctgtaaccgttccactgtggtctctcaagcgatgttatcgttgatgttatgacatttctagccccagaaagtccctgtgctagtgagggccagcttccgtcctcttcgcagtcagcacctttcccggagtaggctctaacataaacaaggcatttgccttctagctgtcatgtattttatgcaccatgctagctagtttttacttcatgtctataatatatattcactttagagaaaaaagtatgcgttagggttcagaggttaaatctcaaattcaagggcatcatgaaaagatgtgtgtgtttcccaagaactaaattattctgttacatatttcaccaaagattaaattccaaactagccactaaactctcagtagatggcactgaaggtaatttatccctgaaatatgtatttagggtacacactaattatgattagagtattaatttgctcctaaatacttgcattgttatctgtcattagcatttcagatttgttcatttgttcatagcctctacttttttttcccctcaaattgaatgcagtctagtgtggtaggtaatctgttagctctacctcataaaatttagattaattatatcttaaaggcccttctttatatagtcctataagtaatgtatatgttgaggtgagggagtcaacaaatggcttttcttatttctaagcgcaatgactactttcttctcaaatgctgaataatgccgaataaatgctgttaagtgataatgaatgttgataagtgctgaataaatatttgtggaataaatgaagctgaatgaaccaatgaaggaatataagagaaaccgaaatgtcttggcctttaccagcctatgaggttatatttcctcttgaatattctatttccttaaacaaagaaatagaatattctattaggaagagccctccaataaaggtgcatattccatatagtctttctcattcacctagaaaaaaactcattatgaaggtgttgcctcttactttcaacaccatacttttttttttttttttttgagacggagtctccctctgtctgctggcgtgcagtggcgggatctcggctcacctctgcctcccaggatcaaactattcgcctacctcagcttcctgagtagctgggattacaggcgcacatcaccacacgcagctgatttttgtatttttagtagagacggggtttcaccgtgttggcctggctggtcacaaactccagacctcaagtgatccacctgcctcggcctcctaaggtgctggaattacaggcgggagccaccttgcacctagccagtaccatacttttttttagtaacatctttgttaagataccataccatacaattcattcatttaaggtgtacaattcagtgatgtttagtttattcacgaagttgtacaactgtcaccactgtctaatttcagaacattttcatccccctaaagataaaacctgtaaccgttaacagtcactttctgttccttccagacctgataaccactaatctactgtctctgtggattttcctattctggacatttcatgtaaatgaaatcgtaatatatgtggccttttataacttgtttcagttatgttagcaaggttcatctgtgtcgtagtgtgtattagtacttcatttcttttttcttttttttgagatggagttttgctcttgttgcccaggctggattgcaatggtgcgatctcagctcactgcaacctctgcctcccggcttcaagctattctcctgcctcagcctcctgagtagctgggattacaggtgcctgccaccacgcccggctaatttttgtattttcagtagagacagggtttcaccatgttggtcttgaactcctgacctcaggtgatctgcccgcctcggcctcccaaagtgctgggattacagcgtgagccaccatgcctagccagtacttcatttatttttaggtctaaagaatatgcagttatatggatgtaactccattatatttacccattcatcagttgatggacgcttgggttctttttactttttagctattatgaataatgctgctatgaacattcatatacaggtttttttgcggacacatgtattttcatttctcttgggtatattcctaggagtggagtagctagtggagttactgtatgtttaacatacagtaactgggcaacagaggagactctgtctcaaaaaaaaaaaaagtatgtttaacattttgagcaactgtcaaattattttccaaattggctgtatcattttacagtcctaccaactgtatgtaaggcttataatttctccacatcctcactagcacttgctattgttggcttttttagttttagtcaacctactgagtgtgatgtgatgtctcatgtggtttagatttgcatttcccacatggctaatgatgttgaacatattcccatatgtttattggctattgctacatctttggagacacttctattcaaatcctttgctcatttttaatcctttgcccagttatcttttcattgttgaattataatatttctttgtatattcctcatacaagcgccttgtcaaatatacgatttgtaaatattttctctatttactgggttgtattttcattttcttgatggtgtcctttgaagcacagaagttttaattttggtaaaatctaatttatttttttcttttgttgcatgtgctcttgttgtcacatcaaagaaaccattgcctaatccaaggtgacaaaaacttactcctatgttttcttctaagagtttcatggtcttagctgttaaatttagctctatcacccattttgagttaatttttgtatacgttgaagtattcgttcaaaagaatgatttttttttcagattctttcttttgcacgttatcggttttaatatcatctgttgaaaagatggttctttctctcatgaatggtctggacacttttgccgaaaatcagttgacctcaaatgtaagggtttatttcagggccctcaatttcattccattgatttatatgtctgtccctaggccagtaccacactgtgttgactgctgtagctttgcagtaagttttgaaattgggaggcagctgttaatagtaccttaagatcaaagaaatatgatgctcacatcgcatgagctatggactctatcctacattccctgcaagcaaaacatactgcctttggatatgtaatataaaattcaatatcaataaattctgggctgtctgatttaggtaaccacacatttggagccctgacaatctaatccactgtttccccaaatttgaggtagaactcatttgtccttactccttttctcagggtctcagttctattgtctgcaaacaaccactcaaacaagaatgttagtgatttcctaacagcagtcactattttacaggccaggcacaatctaaatccatagagaagaaatatttttctctaggcatgaaaatcctaggagaactgttaaataagcaagaggaccatttaacattgtccagctgggctccatttctaacttttccaagaccagtggagaggtaattgctgtatatttgcataactaaaaggcccaccttgtactcgttttctaagaacaatggacactgacccaaggtttattttaaatgggcggtttttctatctctaccagagtactctgtaataaataatttctcctaaattttcttaggtctttcagtcttcctgttggccttgtacttgctattccctttatctaggaccacagaaaggctgtgaccttcagtaagtttctatacccctctgaattttgctgccttcatctattgaatggacataatgatagtatttgagaattatttaagttacatagtatccttcagagttgtgaggattaaatatgcctggtaagtgtaacctgtgtgtgtgtgtgtgtgtgtgtgtgtgtgtgtgtatttgaacaggttttcacctagtcacatgtagatgtacattaacatgtgaatgctctgatttcttatctcttttgtctgtgagtattctagtatttattatgctatatgataattacagggtatagttttgtctggctctctcactggtccacatacaccctgagaactgaattggatccatgtttttatattttacttggtattaaacattggtacatagtagatgttcagaggtttcaaacacagttggcagttgttctgtctaggatattagcttcattttactctaaccagccatttatcctacataaaattcaaggtcagtaatcacctgagatttctaagaagggattattattaattaattactgatgctgtcaagaacttgttaattctcctctatgtttgaataatcaagtacctttgggcaaatgtgctgtaaaaacttgagttatccatactcagtatggagatttcttttgtttatttttccttcttcccataaatatttaatgaataccaactggatagcaagcaatgcgttggacacagggaatgcatcaatgaactagacagatatgaagtctacatccagtagggaagacagacattgaacaagtaacctcaagtgtggtgaatgttaggaagattgaaggtcttgaaggaacgaagggcagaataagcagtagaaaagcgggaatgaagagctgacctaaaagtagtgtttgtatataaggtaatttttcaactttttaatttcaggaatacacgtgcaggtttgttacataggtaaacttgtgtcatgagggtttgttgtacagattatttcatagcccagatattaagcatagtacccattagttattttccttgatcctctccttcctcctaccctatgacctccgataggtcccagtatctgttgttcccttctatgtgtcgatgtgttctcatcatttagcttccacttataagtaagaacatgcagtgtttgattttctgttcctgcgttagtttgctaaggataatggctccatccgtgtctctgcaagggacatgatctcattgtgtatgtaccacattttctttatcagtctatcattgatgcgcttttaggttgattccgtgtctttgctattgtgaatagtactgcagtgaacatacacatgtgtgtgtctttataatagaatgatttatattcctttgggtatatacacagtaatgggaatgctgggtcgaatgacatttccatctttacatctttgagggatcgccacactgtcttccacaatgcttgaattaatttacactcccagcaatagtatataagtcttcatttttctctataaccttgccagcatctgttatttttttactttttaatatggccattctgactggtgtgaggtggtatctcattgtggttttgatttgcatttttctaatgatcagtgatgtcaagctttttttttttttttttttttttagactgagtctcgctgtgtcgcgcaggctggagtgcagtggctcgatctcagctctccacaagctccgcctcccgggttcatgccattctcccgcctcagcctcccaagtagctaggactacaggcacgtgccaccacgcccagctaattttgtttttgtatttttagtagagacggggtttcaccatgttagccaggatggtttcgatctcctgacctcgtgatccgcccacctcggcctcccaaagtgctgggattacaggcgtaagccaccacacgcagctgatgttgagcttttttatatgactgttggctgcatgtatgtcttcatttgaaaagtgtctattcatgtcttttgcccactttttaaagtggtggttttttcttgtaaatttaagttccttatagatgctagatattagaccttaatcagatacatagtttgcgaagactttctcccattctgtgtgttgtctctttactctgttgatagtttcttttgctgtgcagaagatcttcagtttaattaaatcccatttgtcaatttttgctttagttgcaattgcttttgttgtctttgtaatgaaatctttgcccgtgcctatgtcctgaatggtattgcccaggtgttgtcttccagaatttttatagttttgggttttatgtttaagtcttttatccttcagttaatttttgtgtatggtataagaaaggggtccactttcaatattctgcatatggctagccagttatcccggcaccatttattgaataaggaatcctttccccgttgtttggttttgtcaggtttgttgaaggtgagatcgttgcaggtgtgcagtcttatttctgggttctctattctgttccattggtctgtgtgtctgtttttgtaccaataccatgctgttttggttactgtgtccctatagtatagtttgaagttgggtagcatgatgcctccagctttgttattttgcttaggattgccttggctattcgggctttttttttttgttccatatgaattttaaaatagtattttagatgtttaaggagaggtataaagtggagggatacaaaaaaaagagcaagacatttcaagtgaggagaaaacatagactgtagcattcatccattcagatatttttctgagtgcctactctgtgctgggcagataaacaaagccagacccagtccctcatcttaactagttcatgttctagtatggaaggaaaatgttcatcaagtaatcacactagaaatatgtgatcaccaattgagacaaatgctaagaaaatggtagtggttctataatgtttgtgacaaaggaaattaacatagagagcattaagaaaaacttcactaagaaaatgattgtaactgagatctgaaggatcagtaaggattaaaaaggaaatgttttctagacagaaaatacagaatgtacaaaggtgctgtggtggcatagagcatggtattttcaagggattcgaagaagacctgcctgtgtggctggagggcacagagcaaggctgaatgcagcagagcagaaagtggtgggagggaggaagaaaagggaagagagtttgtcctgcattttagctcaagatttactgaggccactatgcttaagcgtgtcactttactgacttaagattaggaaaattctcatatggtcccattaagcatgctcagtgtcttgaagtctacatggtatgcaagacagtagctttctgtaagtctaatcatcagttcacacatcgtcaaccatccacctgtaacaataacaggagctaacacttctcacttgctttgcatgtaccagccattaaattaggaattctcttttttaatacttacctcaacactagacacctgtactcttgatgttcccattttacgaaggagagaactcagacataaaaaaattaaataacttgccaaacttcacacagctgggaagttgaagggctagggtatgattccaggtaatttgacttcagtacttgaattattaatcaccacactatactggctttctgatatttttactatggtgaaaatgcatttccgtcagagggaataatttgtttgagaaactcaaaactgagtttagaatttgatggtaataaaatacccagactcaatttctaaatgccgtactgtcaactaaactccacttgcatccataggtgaaaaggtgaagccgtgttttgttcttttgccagtaagtggcagtgctgagtgtagtacaaagagatagaggatagggtttcaatatcaccactcgtacttgtcgtcactgagtttctgcacggagatgaaaggatgagattgaagatgctaacgaagtcaggaaaagcccacttaaccgacagtgctagagaatggagctcaagtaatgctgatagtgctttttttccgggttaagaagacatttctcctggctccccttcctagagtatgtctcacatagttattttaagaattagaaaacatatgtgaagtacctggtctgtagtaaaaagggaaactatttgttttcctgggattagacagctaatcaaatactgctctactagcctgctgtgtatttttaattttgcttaataattttaaattattaatcatcaattaaatatgggatagctataattagatattttatatgccttagagtttttaatacctgtgaatagctgcacatataagttcctctgtcgtctttgtttctagttataaaacaggtgccctcagagagcatcctacagattgataaagcaagtgccacctggagaaacctaattccttattcaagaaatcttcatatgccaagaaatacatagcaagtaataacctaaaactgatcaaaataaatatttagtgactgtttcttcaatgatgacactgtacccacacacacagaaactaacattgttggtgctggaaaggacaaatcaccagctttgaaaatgtatcatgaacttagggatttgggcagtgggagaggaacagccttccagaatttgatcagctgtctatagcatttccaaatgaatcctactttatgatggcccttgagaaggcatccctcatcaccactctttccaaatcagagttaaagcccagagtcacaatagggcttcctttgggggtttggttcaaaatttaaatatcacctgtctctgccactctggttaatgtggccttcttcagtgactgcctctctcaatgccctgtggatttccttcacctttctcctgatcgcatctataattttatctataagtctaccttttgctttgtcagtcccactagaaactccaccagtgcttcacacacagtgttagatacattttttagataatcaggctagtccaaatgaccatcagttagtgagtggataaagaactgtggtatacatatatatgatggaataccactcaaccataaaaagagaatgagttagtggcattcgcagcaacctggatgagattggagacgattattctaagtgaagtcactcaggaatggaaaaccaaacatcgtatattttcactcataagtgggagctaagctatgaggacgcaaaggcataagaatgatacaatggaattttgggacgcggcggggaaaggtgggaagaggatgagggataaaaggctacaaattgggttcagcgtatactgcttgggtcatgggtgcaccaaaatctgacagatcaccagtaaagaacttactcatgtaaccaaataccccctgttcccccaaatcctatggaaataaaaaattaaaaattcaggagatgcaatagtagcagagcacaacgaaataacagaattaaggacacattcgccatatgtctcttttatattgagaacacagcaatattaatgaccagatgatgaccttcaacctaaactggaagttgtgtgacaaagtccatgttggtttggaagctaaaggtggaaagtgagattaaatactatagggcatggaatggtagtgacctgcaacttggagctgatgtaaggacttgataagtcaaagctcactaggatgcaatactagaaaaaatggtcttggtgtatcacatggattaagtgagattaaaagtagtttttttattagatctcaaaaaaaatataccaggctaataagtcattccatgtaaaagcgagggtgacaaagagaagctggtaagaaaggcaaccttgaaagtcttcacactttagagctaaacatgcaaaatatattcagagacaagatgaatgtgctttccttttggaagtgatattgatctggggagagggggagggtgatcttccaaagactttatttcttttgttatcaagtgattggtgtgagtgcacccttttgatcagaggtatgtagacatgcttgagtaacagctctctctctcctcttattgaactgctttttgtgattgatttttaaaataaacgaattgtttgcttcagctaatcagggactagttagtgtatcctgaaaaaggaagtttatataagtgctctttattacctttactgagtgagtgggcttttttgtttttgtttttgtttttgttttttaaattttcagttagttgccccattgacagacaatagagataacagtgagtccatggaatacctcatggtggaaaatgcacagccgattagaaaaatgttctacttgagcgtaccaaactaatcccaaacagtgaattctgatcccctttctgtctcagattttctctatgatcacgtcttacgataataagaagcaaagtctctaatggaagttcatcagtggcaacaactgtggctaacctgacaacccagcacctagtacagtgctcacaggcagctggtgttcaataaaagcttcttacatagctcaccttctcagtatttttgtgtttttttcctttaagtggttagaaggcagaatttaaaatattgtcacatagcagtgggcgtgtaaggtcatctgctgtttgccaaccaaatggtgaggctagaaaacatttgcatataaatgttacatttggttgaggcttttaaattacagaaatgtaggtaaaatggtcagagtggcagttagagatgaacaaatgttttacatctgtggagccttcatatttattgctttgagtgtcattgccatttcctgctggaaattaaacatcacaaatgtatccttcatttgaccaggtggcctcgatgcttctgaaatgaatggcgaatccggtaatataaattgtaatcacatcacaagcatcttcctcttaaccttggtaatgatgtgaaatagtgcattttaagcttgttttgaaggttaagcaggaaatcttatcttggataattaatatttcaacaaaaatcaatgtggctacagttagcaggtaggtaatctgactaattggctcaatattaaatttgttaactacaaattgtctttcagctgaaattgtattggtagaaacaaggaaattggtgaagtatttactagatttgtagcacagtcttgttcagcttgctgtagagagcttgtgatttaaacatggtggaccaatgggagctcattctccagccacctccacagcagtcctgatgacttcccctatctactttataatggcacttaggctgaggcaggaacatttcctcaggaaattgtcaccgtgtccacagaaagtgggttggtcctctgtgtctactgcttcactttctccttaataatccaagccagcactttatgccttgaaaaaaataactaatagttaagttgtctatatcgttttcctttttagaaagtactttcaaatctgttttatcttttagtctttacaaaggcctgtgaggtatgatttatcatcatcaccatccccatcttacacatgtagaatgtgaagctcagaaataggaagtgacttcctcaagttcgtgatcccattaagggacagatccgaggatcaaaacccagacttttgacttcaagtcttgaagtcttttcattgtaccatatcttcatttaaaatggggtccaccctgaagccaaagaaacacatccttactagtaggtatctgacatttgtcttattttgtgaaaaagatattttgggagcacaccttcaaatgctggttcccaaaacttacctatactgaaatttccaccagtctacgcaaatatgcactacattattaaaataaggtggccaggcacggtggctcacacgtgtaatcccagcactttgggaggccgaggcgggcagatcatgaggtcaggagttcaagaccagcctggccaatatggtgaaaccccatctctactaaaaatacaaaaacaattagtcgggcgtggtggcgcacacctgtagtcctagctatcctggtggctgaggcagaagaatcacttgaacccgggaggcagaggttgccatgagccgagattgtgccactgcactccagcctgggcaacagagtgagactctgtctcaaaaaaaaaaaaaacagaaacaaaacaaaaggcagtgtttagtcaattaaaggacagtttttctgttgatactatctttctgtaatttttcacgttgaaaagttctgtcttttatgtattgatgatggtagaaaattgtggtggtactggtggtaacttttagtatccatagttagaaacacctatgttggtttcacacacatctcatatttccccttaaaattctattgctccattaaatccaacactctgtaaaccaggattttaaaaaacaacatacagatgatagaatgggtggcaagtaaaaatgcttcttgcctgcagcacaggcccttagaaatcatcagcggagccaagggtctacaacaagcagatcaaaaatagcagcaagacaggctaactatcttcaggaatcaatgccagcctcttatggcattccctagaggccatctcttgggccttggcacctgtgctagtttcatggttagattagttatgtcctgttgctgaagaacaaggagtgacttctcttccatctctctctgtctctttttgtttgtttgtttgtttgttttttttttttgagacgaagtgtcactctcttgcccaagctggagtgcaatggcgtgatctcagctcactgcaacctccaactccctggttcaagcaattctactgcctcagcctcccgagtagctgggactacaggcacgcgtcatcatgcccggctaacgtttgtatttttagtagagacggggtttcactatgttggccaagctggtcttgaactcctgacctcgtgatccgcctgcctcagcctcccaaagtgctgggattacaggcgtgagccaccgtttccggccctcttccatctctttctatttagctttggaggaaaatgttagagatttaaaaccatttgctataaggcagtattgccttttgcacacacaaaccttccctggtgggggagggccaagggccctcagcttccttcatcccaagagaggaagtgcattgttataaaatccctcatcagtctggctctaccaaagaaaaggtatcataaaagcttcagatctctgcaaaatagtgtctctttttctacagatctttcttgcctggcttctacacatgcatcactgcactgacccgtaaggattaaggaaagtaaacaaacagaaactatccagggctagagataatcagtggaccaggctgagcaaaggaatgtaaatctaagtgtcatgtggctaagaactgctgtttgaaaagctgacgcagtgggaatagcaagagttgacaggcaatgcttagtgtatggtgagatgctcagtgtgagaccagttaccatttgaggcatagctcaggggctctgctaccaagcatggcagataactcccagaaacacacacaatgcatatccaggtgatagtaacaatgtgttttactgtgttttcctcattttttggtttgcttttctattaaaaattcagagaggggtgcatatgtgcttgaaaaatactgtttccccttcactggtagtgtctagcatccctgagtggtctgaaatggaaagagcaacatggagcctcatgcatcttcacagagatttgtttccaaagtcagcacttaaagcaaaatgactgtcattaaagttaccctcagaattctcttaagttggaagtatacatacccatgggagataggcatgccacctctcccccgaggatggaacagacaagtaattgtttctttggttgaaaagcaggtgaagaattaacttaagtttagagccacattgcatgagaagtgggtatctttaaatactctacaacatgggaaggtactctctctatgtgaagccagtgaaaattgaaactgaaaaataaaagagatttgggtccctcatctctaatgcagtgttggaaactgatcaagcaagccacatggtgggcagaattacccacactatttacatggctacctcttctctctcacacatatcactccaatatgtgacctctggcaaatcattctacctctctgagtctcagtttcattctctgtataatggggatgatgtgagtatcaatggccattttaaggaccaattgagacaaagtatgttgacatattttcttccaattatgtaaatgtcttatataaaataaggcatgctttattgaaagaagataatagaaaaagatctaaagaaaaaaatctgaaaggagtaaaaataaataaggaagatcttgtactttagtggaagagaaagacatacagtattaattccaggatattatgtggtaaatgaaaagacagcagtgtgcacagtatgtaatgaaaacatggagaagcaatatgtaatccgtcctggggtacacagtaggctccccaagagagacagtgactgagcagagtcttgacagatggttgatagttaaagaggccaagagagctggcagggtgtttcatgcgacaagaacagcaaagcctgaatcttcatggatatgcacgggacatggaaacattccatgtttcaaggttgtcaaatatgaactggagagtgggaggctacaaggggagagagagagagctaaggcggggagatgatggaggaccttgtttgacatggtaatgagctttagctaatcttttggtggctgacgatctcaaagggttttaagccagcagagtggtataaccaggtttgcattttagaacttgattactgtggcttcattttggaatgggcatttaaggcactaggataccagcatctggaaaaacaggaaggctttccaatatcgcaggcaagaaataataagagtctatcctaagacaaaggcagtgaaagtagaggaggcatatttgaaaaatacttttgtggtgaaatcgtcaaggttcgttggatggtttgggtgaaggtagggacggagactgagagtaaagagtacagaaagaaagaaaaaaaagatcatagaatgactttaaagtctaatgtcttggatggtggggtatcattgactaactttggaatcaggttagggttggagattaagaggtggcaaatttactttaagacataccaagttgtgtgatttatcacacaaacctggattcttatgagtgtgaaaagtgccactgtcaataattttgccaggacaataaatgtaaacctcaattatttcaggaaaactagaatgtaaagtcaccttatctgtaggatactcagcagttgaatatatgagaaatactacatcgatagggctgaaggtttacagtaaatagacatgaacataaagattagattttaaatcatgagaatgtataagatcatccaaaaaagagagaaaagcaaaggcaccttggtgaaaactagtgtttgaagggtaggtgaagttgaaagagccctcaaaagagactaagagggaggaagagaagagataggaatcaggagaggatagagagcagatattttcaggaagcagttgaaaatgtccagtacaacagagaaatcagataagataaggattgaaaaatgcccactggatctggcaacatggaattgacttttgccagagcggtttcatgggagatctgaggccagtatccagatagtggggttgtagagtaataagctttagttaatcttttggtggggggggttgcagagtaaatgggaagtcaagaagtagagaaagcaagggtatacctgaagaaggaaagagaaagagaagtgcacagctgaagggagtgtagagtcaaagaagtgttgctttatatattttttcaggttgacaaaatttttgtatattttaataggctgaaagagaaagtttaaagacacaaggtttattaataagttggtagtagtactgacttgttagatataaagtttgtacaagttttattcaatgatatattaacttatttaagttttgttttacattttgctctgataagtagtgggtagggaagggaatccaacattcttacggggtactttccataacacactgattgcagcatggagaacacttggcaactggaggaagacctcagaaaagtaatgcatgtaggattctagaggaagatgagactaggtgttcggttgggttcctgctcctgaatttgtgcagtaaggccgaaattccttactgtagacagatttccttgtctatggatggcaactatgtcaccttttctaaacaccctgtgggcattacaggcttagggggttaccaaactctggcactgagtaataatgaagccttcatctcaatgtagtagacttttttttttttttttgagacggagtctccctctgtctcccaggctggagtacagtggcatgatctggctcactgtaaactccgcctcccaggttcaagcaattcacctgcctcagtctcccaagtaactggaattataggcacccgccaccacatctggctaagttttatatttttagtacagacaggatttcaccctgttggccaggctggtctcgaactttggacctcaagtgatccacttgcctcaacctcccaaagtgctggcattacaggcataagccaccatgcccagcctcgatttagtagacttttgaccaagacaaatattagtccagaaaagatagatcaggccgggtgcagtggctcacacctgtagtcccagttacccgggaggctgaggcaagaggatagcttgaacctgggaggtggaggttgcagtgagccaagattgcaccactgcaccccagcctgagtgacagagcgagactccatctcaaaacaaaaacaaaaacaaaaaaaagaaaagatatgtcagctgcattacccccaccccaatctccatttcatctgccaatcttcttgccttctgatcaacctacctttcctaccgccattgttccttctctcttccacgtcacttttatgttatggtatctcacttatctcctctactttcaaagtaaccaaacacttttctttccttgtgtgcatcaaaatgaaggagggacccatttcctctacaaataattgactgaaaaataatggttgctcttcactccattagctcctgtgaactttagaaaacaattgatagcttatgtattttcagttttggaaaaccttcaagaatagctgaactttggaactgcatactagacctagcaggatgggacagcaaatagaataacactccttcaggctagtgagtgtctctttgttttcatttggaaagactgcaggaggatgactgttacagcagttttggaaccattgtgtaactgtatcccacgagacaacatcatttggtttcaagatgtttatttaatactgttttcttatttgtattaaccatcaacaacataaagcagatgcacattgaggctgtttacaaaatagcctgttgtacttgcaagatttccaggattcttatgtcaattccctttcaaccatagcctgaacagtcctcttctttggaagcacggacagcgatttcagcttcgcaaaaggctagttgtgcttataacgttcacccagcagcctgctggtgctctttattcatcatatgctctgtgggacagtcatgactttccagcagacataagtgatggtttgcttttgcatcttaaaggcattaatcttgtatgatctgatccatatgctttgtacagtgactgtaacaattaaatgttcacatggactcttttagggaattgcattggcttatttcagaattcaaatactgcttagtgtttttatttccagccagttcattcttatgaatctgttttcaagcctcatctcttctcctcccgtgttctcccaccatggccctcttccccatgcaaaactcctctgtacatagagttcctatggaaacataccatgtctgaccaccctctaggaagttgttgcccatcatttaatctctctttatttgattttattattcttattatttttctttgagacagagtctcactctggagtgcagtggcacgatctcggcccactgcaacctctgcctcccaagttcaagtgattctcatgcctcagcctccagagtagctgggagtacaagtgcgcaccaccacagccagctaattttttgtgtttttaatagagatgggattttaccatgttggccaggctggtcttgaattgctggcctcaagtgatctgcctgccttagcctcccaaactgctgagatgacagatgtgagccaccacacccagcccatttaatttctgtaatataatgttttaaaactttgcaacagagcagttattatcactctttgattatctattttttgtcttttttactaagctattgtctgtcttcttcactacaatatgagctccatgagggcgggaaccttttataatatattcggtgctataataccaacacctagcattggacctgacccatatatgcagttaacatatatttgttgattgaagtattgctcttcagcccgaactgaccccttcttcctttgcgctttgcattttatacatacttatgtcatagcatatttattgcatgtgtcaaccttaataaccggattcaagtgaaatgattattgaacttatttgaacacaaagtttgaggatggccacccagaaggacacagactctaaaagagtggagtcatggctccaaagtggggagatttgagggcccctcttatattggcaaggtctggggaagatgagcaggattacatcattttccatacaggattggtgaatagttaacagcaatttgattggttataagtgtttctttttttttttttttttttggaaagaatataagtgtttcttttttttttctttttggaaagaatatttaggtatatttaatattccacatgaaggatgtaatagtcaaagggtctgttgtctcagtcaaggggtcctctatctcagggccatctcctctgagccaggaataaggaaataaggtaggaaattaatctataacagaaagtcagtaattaagaggtcaagctctgtgacttgatctccaaagtcaacattcctcagggcctaatagatagactatccattttcttttacacgtgaatttgtgtgacatgccctctactcttggtagaattggtagactgtaaacttcttgaggaaagggactgtgtcttcctcctctttggttccctgggtcccagcacagagcttgttattaagtcaatgatcaataaatatttgttgattacctataggttcctcttgattaaatttaactgcactaaattttatgtaataagtttttgctgagcccgtagagtacaaagtcctcagttacaaatgtgggctaaatggaaacagacatacccccttcattcaaacatcttatgtatcttaggtatacgatgcagagactctgtgtgagggtgggtatgcatataaaatacattgaaaatccctaatttgtattccaggagagacaccatgcatctttttgttttgttttgttttgttttgtttttaagacagactctcactttattgcccaggctggagcgcagtggctcaatcttggttcactgcaacctctgcctcccaggttcaggcaattctcctgccttagcctcccaagcagcagggattctaggcgcccaccaccacgcccagctaacatctttgaatttaaggatcctttgtgctttcaggaaaatcacatttgtgttttatggtatttaaacagaaattagtataacccatgattaatacccctaacatgagggaaactataagactactcaatattccatatctatctcaggttaattatgcttcccccactaaatttagtaaagaaagatggaaaacaatgagagttactcttacccatctacggctctccaactaatacttctaagagtgtgtttgtaggctctatcagggaatatatttgctcttatgttttcgactgaataaagatttgctttagctaatgtacctggcatggattacccatccaacatcaggtcaagtgaccttaccctctctggtagcagcaaaggacaaaagaccaatcaaggcaccagatcctccagttactataaactgagtcaccttaaaagtagccaggagagtaggctttgctgttctgccacacagcatgtaacaagaaaaatggagtcatgaattcttggtttatttgggaggtatctcacgcaagataccctcaagtggccagttctaatgtatgtccttttacctaggacacaaattctttccaatatggccagcatatttctccaaacatgcataaccaaataattgtatccttttctctgtgaaagtttttaaaagatatatttctcttttattgacttaacctattactatgtctttgtattataatccaatagttttgtttctcagtagacagtaccttcctaaattttaagaaataactgctgggtgcggtggctcatgcctgtaatgccagcactttgggaggccgaggtgggcggatcatgaggtcaggagatcgaggccatcctggctaacacggtgaaaccccgtctctactaaaaatacaaaaaattagccgggcgtggtggcgggcgcctgtagtcccagctactcaggaggctgaggcaggagaatggcgggaacccaggaagcggagcttgtggtgagccgagatcgcgccactgcactccagcctgggcgacagagcgagactccgtctcaaataaataaataaataaataaataaataaataaataaataaaataaagaaataactgtcccagaaatattttgtgttatccatgtatgtataagagaaaaccatgatacaattgttttaaagatcttgaggtaaattacagaatagtattcctgtaggccaaaaaattaaattatgttctcaaaacatgagccactcatgattttttaaaagcaagttctcaccagaaaatcacctaagctctaagacccaaagccactcaaatttcactactgtttttctctgtttacagcatatagaactctttaaaattcctattgctctcactcatattcattataaaaattttaatttactctaaccatgactacattcagtaagtgctgtttcagacaggaaatggaactattatagtgatgaactcctttctcctagttattaaaggaatctgttcttatcatactgattccatccaacttattataatgcatgaaataaccaattcagtgggttcagcataatgggggagagaggggaagaaaacaacacacataataatagctgacttttaatgagaattctttagggctttcaccaagcagatccaaaataatttatcttatgataatatcaaaagcaaattactcacaagattatactgttaaggactgtcacaatattcccagggctgtaatgctgtctcttacagttttagaaccaactttataacttttgctattagttgctaagaaacaaattataattgcagctcagactctttactgtgttagcctcttaatgccccatagtagcatttatttccttcagatgatgaaatgatcaacaaagtaattgttttatatatagctgacaatgaaagcattttcaggaagcaagccacgtttttatgatttttatctggtggggggagggtagttagagcaatgattttaataacatcacgatgttgaaatggcttgaatcttagaccaatatttaatggcttccttttcaggttgtggtgttgtttgttttgtttgtttgtttgtttgtttgtttttgttggttcgtttgtgacagggtcactctgtcgcccaggcttgagtgcaatggtgcgatctcggctcaggtgcacaccatgacacctagctaatttttttatttttgtagaggctgggtttcaccatgttgcccaggctggtcttgaattcctgggctcaagcaatcttcctgccttggcctcccaaagtgctgggattacaggcatgagccacagttggttattacttagaaatcaattttattttattttttagttattatgttggatggaaagagaggttgaagagtagaaactttggagtgagactaataagagtttgaatggtagctctatcacttactagatgtgatgaactttgtgtaagtcatttaatttcctcaaaagcttagtgttcccttctgaatattaaaatgaagatattaatacataccttgtgacatcacatgggcaataaacaggataatgtatttgaagtatctagaagccatacaataagtggtggtggtgatttgtatgattgttaagtcctaaaatgagggggaaaattcttaggatatccttaaaagccttcataaagataattggctaatagagtagagtagcaatacgttatttcaaattagtacactattgactctcaagaattcataccaacgtcagatagtgacataagaaatttgttaatttattcatttatttgaagaactaactgaccattatcattttaagtactcactgataaaaggataaaagtagtggggaggtcttaatcccacagctgtaatgggcaacatgtgatcaaagagaaaaagttagtgtgtatatctgatgtgtactctgacccaacagatgttacatataagaataagataaaactagttgtcctgcaaatctacattgtgagggccaaatgttgaaacagaatgatataaagtatttccaatttagctgtagtaagcaccacagtttttattactaatgccttttctggtacgagacatttagtgtttgactgcatggacctttacagtataggagatcatgtgtgcctgttggcctctgtggaatggattccttgccctctcagccctgttcccctaaaaacatgtttaaaatctctaaaaggctctggatcttccaactctcaatatagaggcatgttctcttttatgcattttctctttggcttccacataagaataaaagactatatattttttaagtagtttctccagaaaataatctggattttaagcttctcttaaagacatggaatttctggcaaccatgtctgccattgagttcctccacatggatttgttcttctactactttgatcttacatgtaatatgcaatcacgctagcctacctcactcatctaacttttgtttctgacccttaagggcaagtgggtttgtagtccttgctattccccagtacatacgcatgcccttaaaattccacgcccgtatggatgaaaaaatgccactttaatatctataataatacattttcatttcctgagaggtaaagttgtgatgctgttggtcatagagaattaaattatctttagcatccctgcattatacgttttagatattgtgaattcgttgctgattgtaaatatctctcacaattccaaacccaagttaagtagaatattttgttctacatttaaataccacttgagcacatgagactgttctgggaactctaggaaagcaggaggcaaatcaactatggtcctgccaaaaatctcaaagcagtagaaatgggaaaaataaaaagaaatatacatggagtggtgaggttcaaatgaaaaggaaagaaaccaacaaacatgccctaagaccagttgaaacagtgtatccacctaaacgaggaataaagatgcttttcatcttaattccagaaagctcaaactcactgaattcaataaataccatttatagtctttattcatctatattcttcattcctccttttgaaactatggagaaaatagttggccatcttgcaggtttatcatcattaacaaatcaaatgtaaaatgctttgcaaagtttttaaaaaatgggaaaaagagcaagcataatactatgctgtgaatgagatctaagctgtatgctaaggatatatgcgtgagtgagcaatgtcaacgaagagtcaaactctttgaagagatattatttgaatgttaatatattaattgaaatacttgaggagatatattctgagccacatataggtgactatggcctgtgacacagccctcaggaggtcctgagaacatgtgcccaagtggtcggggtgcagcttgcttttatacattttagggagacatgagacatcaatcaaatacatttaagaaatacattgtattcctccagaaaggcaggacagctcaaaggtggggggtgcttccaggctttgggtaaattttttttttttttttttttttttttgagacggagtgtcgctctgtcgcccaggctggagggcagtagcgcgatctctgctcactgcaacctccgcctcccgggttcccgccattctcctgcctcagcctcccgagtagctgggactgcaggcgcccgcaccacgcccggctaattttttgtatttttagtagagacggggcttcaccgtgttagccaggatggtctcgatctcctgacctcgtgatccccccgcctcggcctcccaaagtgctgagattacaggcatgagccaccggtaaatttaaacaatataaaggaatgtctgggttgccataagaggttgtggagaccagttttattatgcagatgaagcttttagctagcaggcttcagaaagaacaggctgtaaaatgtttcttatcagactgaagtctgtgttgatgttaatggcggagaggtataaagagtataaagaggcatgtctgaccccagcttcccttcttggcctgaatcagtctttcaggttacgttttaagagccctggttgaggaggaagtccatttagatggtaggtgggggggggccttagaattttatttgtggtttatagcaagatacctctgcatgctgtatgaaccctttcagtctgccttccatgattgcatcttttcactaaagagcttcctagtggcgatgaagacttgaaaatgtaatacatacccataactgattcctaccttcttattctgtgtgtgtgtgtgtgtgtgtgtgtgtgtgtgtgtgtgtgtgtgtgtgtgttttaatgggaaggaaaccacagtttctaaatggtcccaccttccttattaacaaagaattagcataagtcccagaacattatagctgtttctctaagaagttgtgatataccaccgggcgaacaggagaccaggtgtcatgattcagtttggggatcgaaaactagtaacaacttcactttgaaaatcttttcagtgcccattccctggggctttcaggctaagctactgcttttatttctctgctatttaatgtataacaaaagaaaaagaaggcatgtatcctggagccctgtggtgaggaaaagcaacttaatgtttatgaagtgctttcaaggggatcataatcttaggaccaatgagtaacccggaatgagttttgtgtttctcttgggtctcctggcctgatccataaatttacttagctatgtcagggatcctagagaatactggtccagttccctaactttagaggtgaggagtgccagtgcggtggcttacgcctgtaatcacagcactttgggaggcagacgtgggaggatcacttgaggccaggagttcaggaccagcctgggcaacacagtgagattttctctctactaatttttttttttttttaaattagcaggacatagtggtggtacatgtctgtagtcctagctactcaggaagctgaggtgggaggatcacttgagcccagcagatggaggctgcagtgagccataccatgtcactgcactccagcctgggtgactaagcaagattctgtctcgaaaaaataaataaaaataaaggtaaggcagattgaggccttagagataattcgtcttgaaaaaggtcacagcagttagctgcagtctgaatgctattattaggacttcctgtccctctccacactatacctattgttttcacagggtgtctctcctttatctccagaggcagttcattggattatcactgggatcaatggatcagaaggaataagggggtgaagtaggagccaaaggaagtagttagaaactaattgtgttttttctcagcaggattcaggctttttctcagcaggatccagcttttaaactttttaacttctaaacttttctctagagtaattgaaactaacagtattttagtggtgaaatgtttgcagtgcttagaaaaatctcgaacaaatttcatgtctctcatgttataaaacagcatttgaactcaagactatagaagagttgtaacgtaaagacgaatccattttcggcattttgaaatatcatttgatcactgcaggctaattgctgctgttcctaatccaccaggttgacacttaatgaatgttcatgatgaatccgttctttagttagttgaaccctataattttcttgcttcgttttcaatttacaatatttgtaataaaggtgccatgcataattccctaggaaaggtcaatatactcttttattaaccataagcctttctggtcttctgggtgtatatttgtcagggaatagactattcttttatgatttcaaatgttagattgtacagattggttatctttactatattacctgctgaaatttctacatatagacatttagaaaattgggataatagcaaccagccttttttactattctttcaggaatgagaaactcaaacgtgtgtggggaccgggtatgtaacatgaatgagtgaacggggaatggatacaaggccaaaagagacaggtggatattatggtagactggagctcatgtgttctcccttaccgcctatactgttttgaaaacaatttaatcattatgctaggcaaacacaacacattttgggctgattttctcaactttgtttattgcgcacctccacatccgtttgatcttcgaaacacaatatagggagaatataattagacccttttttcagatgaggaaactgagttttagagaagttaaggtctttgcctgaagtcatacaactaagaagtggtagaaataatattcaaagttaaaccatactctgatgcctgtaaaaccaaaactgcactctaaggaaagaaagatcatgtgatgaatgcagttcttttcagcactgaaagaacatcaagctggaagttaagttaaataatgtgggagcattacagtcacctagaaaaagcagagttgtggtggccgacctggctggattaaaatcccagctgtgcttgtcacctgacagccatctcactttgagcaagtatttaatctctgaacttcatttccccctctgataaaagagataatatgactcacctgaccagatggttttaagaattcaataccatggctcatagaaggtattcaataagcgctagttccctttctcctacagaagtaagtgctggtatgagtatagggaagattttaaactaatgagttctttctttttgagtacttggataattatacttgagtagttcctgcttggatatactctgaaaacttggccttcttggccctggacaccctaaccccctgcagtcttatttattcattcttctagtcaaagacatgggcaagtacatgtgttctatttgtatataagtacacatttgtacatgcgtacacacacacacacacacacacacatatatatagagagagagagagagagagagatttaatatgataaattggcttacatgattatggagtatgaagtcccatgaccttctgcctgcaaggtagaaacctaggaaagctggtgttataattccagtccaagtctgaatgcttgagaaccaggggtgctgatagtgtaaattccaggccaagggcaggagaagagcaatatctgagctcagtaggcaggcaggaagcaaaaggagtgaattcctcttcctctttcattctactcaggccttcagtggattgaatgatgccaaccacatagttggggggcagtctaccttgctgagtccactgattgcaatgctgacctcatctggaagcaccattacaacacatccagaaataatgtttaagctttgcactccttggcccaaattaacatataaaactaataatcacaaatgtttaacacaaacaagttacagtgaaaatacaactggttttgtgatagatgggaactggaaggaaactcgacaatgagtggtcaggaaaacccctcagatggcaggattacattgcataatttgtgctaccaccccatgtggcggctctgctgaagtgatacggacaggagacagggatatactgggtagaagggcagtccctagtgagggccacaccctcaagcctggactcatggcccaaagtgagaacatgccttcctgttttcccacccacatgttgcctttcccagaaccaccctggcccacgctgcccccccccgcccccccatcctgtacccataaaaaccgcagaccccactggcagagcagagaggcgtggcagaggagagaagaggtgtccgaacgttgagaggtgaagaaccagctgggcatcggagactacaatcggagaggatttgggctggggatggttagagaggagtttgtcagccgaactccaggggaagacaacccttcccctccatcccctttccagcccccgcttcctgctgggagccactttcattggcagtaaaagcctccacattcaccaccctccaatttgtttgtatgacctcattcctcctggatgctggacaaggacctgagtgcaggtgcaagaggctgtcacactgaccctccactgagttgttttaacacttaaagtgtccacggacagcaaagctaaaagagcacactgtaacacataccttccggggctccggggccacaggcaacccctagatgctacagcggttctgcacagagtgttgctcctgccagttgcccagaagtgcttgtcccagcctctgcacctgcttacctgcgtgctccctcaccctcaacgggttaagatctgtgggctgcgtaagcaagctaccccttcacaagtcctgtgaagggatcaagggaactgccccatttcaatttgagtttagacctgaaagacaagaaaatgattctcacccctcaccaccatctcctgattacctgaaataatgaacagtgttggtaactatcaaaacccatctctatcattttaaaagtcattatcatgttctggaaatttttttaaaaagcttctactggagccaagagtggctcagctttcaagaaagaatggtttttgctcatgattttctgtattttaaaattattagatccatttctgtgaagtgcaattgaatggtatagtgaccaccatcacaggtcagggagagcagcttttcaggagagtgaaatctggtgtcactcttgaggccaaaaataaaatattaacctcaaatgcagtaagtaacctcagtaatttatacaaatggttctattttttatttgaactattgtttcttggcactcattcatgcaaaaactgggttagaaattggtatagttggttcatgctatgaacatacagtttgatcttaatagttaagaggaataacaaaaacttgaaggtattttaagaaaatcggccaggcgcggtggctcatacctgtaaacccagcactttgggaggccgaggcgggtggatcacctgaggtcaggagttcaagaccagcctggccaatatggcgaaaccctgtctctattaaaaatacaaaaacagccagtcgtggtggcgggcgcctgtagtcccagctacttgggaggctgaggcaggagaatcacttgagtccaggaggtggaggttgcagtgagccgagatcatgccactgctctccagcctgggcagcagagcgagactccgcctcaaaaaaacatacataaataaaataaaataaatataaaaggcatctgaccaaaattagtttaccacttaaggagtaaaccgaggagatatatagtgatcattacataccggaattattgctataaaagccatagtgtttatttggtcagtgtccgaactttttacaaggtaataatagaggaagaagaatcctgtaatgactgaattgcattttctggaattggattccctgaattcagatttagtctagttcacttaccagctatttaaccacagtcacgttatttaacttctctgagtctttttcctcatctgtaaaacagggatgcaatagcgcatactttgttggttcattaggttagctcatgcacaaagtgtacttatcacacagtcctgccatattgttttgtgggtttttgttttttttttttttgaggcagggtcttgctctgttgcccaggctagagtgcagtggtgcgatcttggctcactgcaacctctgcctcccaggttcaagtgattctcctgcctctgcctcctgaacagctgtgattacaggcatccgccaccacgcctggctaaattttgtatttttagtagagacggggcttcaccatgttggccaggctggtttcaaactcctgacctcagatgatctgcccacctcggcctctcaaagtgctcggattaccgtgcccggcctatagtattaataataatatataatgtaatcataagagtaacaactatataccatcacatcatcatcataacagaaatagctaatgtgtattgggtacttaccatgtaccaggcatagttctaagcattaatttcaagtggacatttgggaagagagaagtaattcaggcacccaagggaaatggatttttgaaatgtgaattgtcttctgtgtcctgtggccttccattttgcagacacccactcatttcactgtatgatataatttggaattatttaacccaatggaatataaactgatggaatgtgtattacttcatactatcatgataaaatagaatttggagatagaaataattgatctctcatatgacacaactgcccattcacaacattcttactgaattaagatgttcaaaagcaaactttaaaaaatacatacgtaaggatctatgatatgataatttttaaatactattatttggctaagtattctccacaatctttggaaaaatatactgtcttgttaaattcttttccaattaaattgtaatcccataaagactcctattctaaaggtcaaattaaaaagcatttatcctcagaggctctaaaaaacagtcattagaatgccaacccttaaatggaaacaccattaagctcaatagctgaatagcttttattagaattacccaatccccctagccagccctgcaaccctgctgacaccccagggcctgcaggagaggataacctctgtatttgtttaagaaatgacaagaaaaattttcttttttaaagatataacagtcaaagactttggtctttacatagatgagcatatcaatcttctaagagacacaaaaacagaaaaaaagttctgattctatctgtctttttttttctcctgatgcttttaaggattcccctgtattttattttctctttatgcctttgaggatttcctctggggctctacataatcaggtggatctttaccatgtagatgctgcattcagtcttaatgaaatgatctcgggagccctaggaatttgcctgaccattcaaaataagcatagcaaatgaaatactggtctctagaaccagattgtggaggttgaaattttgacttctcctattacctgtgtgtctctgggaaggtcctttactctgaatctgttttctcacctgtaaaacagtaattcctaatccaaggagcacttgcaagaattgaagatatgacacatgtaaagtgtggaattatgtttagttattattatgcaccctcattattaggaaattgccatgcctgagaaggcttagccctgacctagttgccaaagtggatgcaactcagatttctttttttcttttgagacagagtcttgctctattgcccaggctggagtgcagtggcgtgatatcagctcactgcaacctccgcctcccgggttcaagtgattcttctgcctcagcctcctgaatagctaggattacaggcttgcgccaccatgcccggtgaatttttgtatttttagtagatggaatttcaccatgttggccaggctggtctgaaactcctgacttcaagtgatccacctgccttggcctcccaaagtgctatgatggcaggcgtgagccattgtgcctggcctcggatttattttggtagaaaatagaggataacccaaagaacaatgtagagaggtttttaaaaaaaattaaaaagctaaattagaggagacctggaaaagtatatatctgattgcaagattaagggtaaagttttccattgtttggaactggcccttaattctggttacaatagactagaaaagtgcttatggtgtttagccatttagtagagtatccaaggaaggtagctctttctttgagaaggtacaattagtaataatgatgattctaataatagcagcaattgccatttagtgctttgcatttaccacatgccacgttacacaatttacaagcataatttcacttcttatttaggggaaaaattattatctctttttaaaatgagaaaaccaagatgaagtcaaatgaagtaatttatatggagtcacactgtaagtggtgaagttagaattcaaacctgagtttgttagattttcatcttctgagtgctactgcctcacctggatgaggttccctcttctgtatttggggccatgtaaagggattagttgtggtgaagtgaactggagagagaaaggcattgagccatagtggatctcaagagatcctctgggccagcttgctgccttccatcaggtaaatgacccagccatctaggacagatgcttgctattttttctgaaagatcttcagggatagtcgtttcacaagctcctcagaagggaaaggagcagaatcagtcaagcacagcaaagtaagggcctaagtaggcagatgtgctcagtgtcactgggacccccagctgacaagcttgctgtgcagtgttctgcttgagaactttctgtttaacatgccaggcaaatcagccaccaagtcctaagtccaggaaaatcactttattttctgtgagtgttgcatgaatttatccaactgctttggttgtagcagggcaagtttgatgtctgtcatagacctatccaccttctgtaaaagcagttcagaggatgaccaatgagctatctttttctgccattcataacttgtgcatttccttgacttgcttctgttacaaggaaaatgatcttattttttatgcaaatcttgcacataaaattgataagtatttgatgataatcagcatctgccatcaccattttgcagacatgacagatattattacttttgtttagataaggttcaaatgagcttggatttggttgcttatttaatacttgtcttctctgctagcctgtaaactctgtgtcacaagagtaattacagtgtcttaaacctactatacactgaaggatgaagacaacaaaggcagaccaagatttgagtcggcagaatttcagtttccacaaggacaagccattttgacctctctgagattattaaaatgagttttatcatgtaactcacaagattactgtaaggaattatgcaaataatggtggtattattgttatttttattatttagttcagaaatcactttttaaagatgaggaaactgactgggcatggcggctcgcacctgtaatcccaggacagtgggaagccaaggcgggctgatcacttgagcccaggagttcgagactaacctgtgcaacatggcgaaaccctgtctctacaaaaaatacaaaaaattagctgagcatggtggcgtgtacctctagtcccagctactcaggaggctgaaggggaaggatcacctgagcccaggaggttgaggctgcagagacctgtgattgtgccactgcactccagcctgggtgatggagtgagatcctgtctcaaaaaaaaaaaaagatttagaaactgagctctatacaaacatagtaagagttcacccaagttcatggacaagaagaatgcaaacctgatgcctgatgtattacttttctcagctactgtaataaattgacctacatttggtgacttgaaacaaaagaaatgtgttcttttacggttctagagactagagatgagatacccgaaacttagtaggaatgcactgcctctaggggttttagggaagaatctttgcgtcttccacctcctgatggctgccctagcattcctgagcttgtggccacatcttcccagtttctgcctctgtcctcacattgccttctcctctgtgtgtctgtctaatctccctctgcctcactcttagaaacccttgtcatcggatttagggcccactcagataatccgggatgatctccttatctcaagatccttaccttcctatgagatgggttgataggtgcagcaaaccaccgtggcacacatttacctgtgtacctgcaatcctgcacatgtacccctgaacttaaaataaattaattaattttaaaaactcttaaccttatttatatctgcctaggtcccttttcctagttaaagtcacactcatgcatcccagcacttaagacatggacattctttcggggggcccttatttaacccatatttttacatgatccctatgttttcctgacaaggattctaatttggatgtttttacaataataagtgttatactgtctgaatcaaataataggaatttctactacacaacaatcttcgtgataatggcttaatatataatctttatttcacagatgaatcatttcaagatccatgatcctcctagtttgacagaaataacataatttgcttgaatattaatgttgctcttagttttgagtgagatgtttttaaagtatctaaaactgattggtacacacatcttttcatttgcagctgaatatgtactaattctggctgtgagcttcctaagcaagaatgctagaagccaattgaattagcaaatgcactcagatttttgatagcattattccactgaatgtggaagtccttcagaaagaatcagctacagaaaccgtcttgctaacagacacctgtcaaaaccaattccattcacttagcactcacttctaatattgaagggtgttttgttataacttcagtatcttcccacccttgtgagagagaatagggtgggagagagaaatccttagtttaggctgttttgaaatgggtatagtaataataaatccctcaaattttatataagatgtatttatactttgcattttcaaaatacacattctcaaataccagtatttatggaaacattcctctgatgagtgaagatttgcaaagcagagcttagctttcataaaagatagggacatctctgtcacaccacccatgacctgagacatgtaacctccttggggaagtattattgtttccattatggttgctgaggagcagcaagttcagttgctgaattatttccacatgataggcaatgaaatgaagaaagctaaccttgtataaaatgctcaaaacaggaagacagagttcaaatgaaaacaaattcacaattagcttcatccgaaatagaaacaggtttgcttgctggaaagaaagttcacactcttcactctcgattcctatcacgcttctgcttgtttctccaaagctatatgaaggctggttaatcaccttatctattcataaagtctattaatctttcttattaacttgtaagaccttgtcagatgaggtccaaaaacaagttttaagaccttgctattactactggtaatgtagtaatgtttctccatttctagcttttacccacaaccacttggtttatttccatctataatggaacaaagaactttgagttttactggatttttgtcccttaattacggatgtttgccttcatgaaatatgacgtggttttggtttaatgaaagagcatcgaagctgtcaagaacctcagtgatttttcttttcagttcttaatcactgctatttgagggatgttttgatagtatcatttcttaattgcgttttcgaaaaatgatttgtttcaatagccacatttccagaacttgacaatcacctcactgctgctaccagtatcgtattaccttattccatgctacctaggaaaaataacagaaaaagtaaccatttcttgccttgattacagttactgactacagaataaggagaagaaaacaaaatcatgtggaacttcagattctgagacattaaaagggcccacatagcattcagttagtaacccattcctatgaaagaatctttgagaatgaatcactcaaattcctatctgagaaaaatgaccaactactgcctgccactttactagtgggccatgattagttggaaataccaaatgaaaacatgtactgccatgcatatttttcttggtggtgacatttgtagcataaagtttacagcataaggaaatttaacatgtttcaaattcaccatatctgttaggcatgctttcctgttcattcatctcttttaatagtttggaacaaataatgaaaaccatgtgccatgttttacagattctgagcctcaaagataattaaatcatgaaagaaatgtttctacatctgcaaaaaatgtctggtgcccgatccatcagtagaaaaagacttacaggcaggaagctctgctgcagcagttctcagggtatgcttaggaaggacactgattctcagagagatcaacaattaacagttcacatcttagttttctaaaagacttctgggagtctttgatgctgtaatgtatgttggatagtcccaaaaaggagatacaataaatagtaactcccagtctcttgataataaatccctttttttgttcatagaaaagcactgtttttagaacaaactttgcaaaaactgttaacatagcataagacagtggagtagaagaagagtgaaagtatcgacttgggttctaaccctggctgtacctcaaatagggcatgttaagcatatcacttgaccgctcaaggcttcaacttcctttagagatagaaataagtcatctcttgagtcctttgaaaacttacatcttccattctgtttaggctgctgtaagctgccattgactgtgggcttacaaagaaaggaaatacatttcttacagttatggagcctgggaagtactaaatcaagacacaagcagattcaattcctggttagggcctacttcctggttcacagactgctatcttgtcactgtgcactcacgtggtggaaggggcaagggagctctgtcgggcctattaggggactaatcccattcatgagagccccatgctcatgatctaatcacttaccaatggccctacttccagatacactttggggttaggattttaacagagaatttgaggggtggggtggggacaaacattcattgcataacactttaaaataccataattctctgtccatggttaagaaggttcctgtgtaatatatgtaattccattctgtaagttttattatggtctgatagttttagtaagagttatcaaacccactggaatatttaaatgattaaataacccgaaaaagttactgttttgaaagtatcacagtcatgagcaaataatctaaattaggcagattaaataccaaaattggacctgacaggctgaccctgatcctgaaaggctctgaccttttcctggtggcattggttcaaacatccatcccctctcttctctccaaaaaacatggaaaggaacttgtgtaactgggatttggtgagctcccaatacccttttctcacaactccagtgacattcccacggaggaagggactctataatctattctgttaaatggtgagaagcatcattttttcgtcttagcagtcttatattagagtaacaaatgggtatcttttttttttttttttctgagatggagtctcgctctgtcgcccaggctggagtgcggtggtgccatctcggctcagtgcaagctctgcctcccgggttcacgccattctcctgcctcagcctcctgagtagctgggaccacaggcgcccaagaccacgctcagctaattttttgtatttttagtagagacgtggtttcaccgtgttagctagaatggtctcgatctcctgacctggtgatccacccgcctcagcctcccaaagtgctgggattacagacgtgagccaccacgcccagccacaaatgggtatcttttgattcaaatttgtcttgtatccaaaataggtacatgtgatcaaggcaaaaagaaataaaaatatataacatttgattgtgagtaatcttttcattacacctaatgttaatgtgttcatgattgcagaaggtgtaaataaccatttcttagatgtctagtttattaatcacagaaatatctggagaaaagaacaggattttttattctcacagagaattgttgattgggactttcttgacccgtaagatgtaaaggttaaggttgtctttgttgctttcttttaaattaaatccaagtgcatcttaattaggttaaatacttggttttggaccaaaaaatagggacttcaacaagctacactataacttataccaactgaagttggtagcttttaccttccttcatcattgcagttcttactaaaatggaattagtgggagatgtttcttaaaggattatatttgaaggttttctggaaaccaaagtgtgaaaagttgaagcactcatcagtatggcatgacatgaatttgaagttttttaaaggcaagcaagcagaatcttttggcataccctaatctaaaaatatcacttgattagattcacttttcaatattccttttaattctatggtacggtttttaatgtgcccttatttctctaagaaaaaaatgaagagctagaatctaaaaataaaacccgtacttaatacacaagctaaatatactcccaagttttctcactgctacattaattcaatgaaatctaatttaggctagtaccactgttatgaataaagatgaatacacattaccagttcacattgtgttgtagcatttttctttgagacttatcggaagaaatgttaattgcttaagtccttacataagatccggtgttctttaaagttttcttgaagagagattaagggaaaggtgacaactaagtttgcatttatttttagcttcatcctattctattgctgtattcccaaagtagtcatcctgactttatagcattccttaagagttaactttccaaaacccagatactataatgttgctcagtaccccacccctacttcatactcagattcctacagtagcccttgttgcttataagagtattcccaaactggtgaattctgctcctgcccaatgttttgttattgttgttgttttcatagagatagagtcttgctctgtcacccaggctagagggcaggggcatgatcaaagctcactgcagcctacaactcctgggctgaagtgatcctcctgcctcagcctcctgagtagctagaattataggtgtgcaccaccatgcccaactaattttttaattttttgtcaagctggggtctcactatgttgtccaggctggtcttgaattccaagctatcctcctgcctcagcctcccaaagcactgggattacaggcgtgaaccaccactcccagaccagaatgttaatttagaaagctacactgggaatggtggcttacgcctgtaatcccaacactttgggaggccaagtcaggtggattacctaggtcaggagttcgagaccaacctggccaacatgatgaaaccctgtctctactaaaaatacaaagattagccaggtgtggtggtgggcgcctgtaatcccagctactcaggagactgaggcaggagaatcacttaaacctgggaggcggaagttgcagtgagccgagatcgcgccactgcactccagcctgggcaacaagagcgaaactccgcctcaaaaacaaaaacaaaaacaaaagcaaactccaaagagttcagtgcccagatgttagattaaacaagtccctttactgcaaagtttttttgtgcagaatgaactgaatctccaagagttcaatatagtttttaacctttcacaacttaatcataaaatatttgtaaggcattcctgtttagtaagattattctgtggaagacaaagtaaaattctagggtgttaacaatgtctgttacactatgacccttactcacatttcttgcttcatgtcttttatttttgtgcagataccttactactgtttgatgaccacactgagtattttttttttttttttggtataaatttagaaggtaaaagtgcaattttgtttcatggatatatcctgtagtggtgaagtctgggattgtagtataaccatcacctaaataatgtgcattgtacccattaagtatttttttttaatccctcccaccctcccactctttcaactctccagtgtctattatttcacattctatgttgatatgtacacacgttttagctctcacttgagaacatgtggtatttgactttctgcttgtgggttatttctcttaagataatggccttcagttccatcgatgttgctacaaaagacaagattttattcttttttatggctgagtagtattccattgtgtgtgtgtgtgtgtatatatatatatgtttatatatttatgtttatatagtctgtatatatacatactatatctatacacacataaatctatctatctatctatctatctatatatctatctatctatctcccattttctttatccaatcatctgttgatagacatttgggttgattccatatctttgctattgtgaatagggctgctataaatatgtgaatgcaggtatctttttcttttctttttgagacagggtcacactctgtcacccaggatggagtgcagtggtgcgatctcagctcactgcaacttctgcctgctgcactcaagagatcctcccacttcaaactcccaagtagctaggaccataggcacgcaacaaaacacttggctgtttttttgtatttttagtagagatgcggccttgtcatgttgtccaggctggtctcaaactcctaagctcaagtactgcacccacctcaacctcacaaactgctgggattacaggtgttagccactgcacccagctggtatccttttgatataatgatttttttttcctttgattatatacccggtagtgggattgcctgatcaattggtagttctattttcagttctttgagaaatctctatactgttttccatagagttgtactaatttacactcctaccgatggtatatagatgttcccttttctctgcatcctcaccaacatattcttttttgactttttcatagtagtcattctgactggttgtaagatgatatctcagtataattttaacttgtgtttttctgatgatcagtgatgttgaacattttttcatatatttgttgtccatttgtatgccttcttttgaaaaatgtctgtttgtgtcctttgccttttagtagggttatataggtttttgttgttgttgttgggttaagctccttgaagatcctggatattagttccttgttggatgcatagtttgcagtatttccttctattcttcagattgtctattcactctgttgattatttcttggctgtgcagaaacttttaaattaagtttcatgtgtctattttggcttttgttgcatttgcttttgaaatcttactcatggattgtttgcataggccaatgtcctcaagagtttttcctaggttttcttctagtatttttacagtttcaggtcttttttttctttgagatggagtctcactctgtcacccaggctggagtgcagtggcacaatctcgggtcactgcaacctctgcctccggggttcaagcgattctcctgcctcagcctcccaagcagctgggactacaggcgcctgccaccatgcccggctaatttttgtatttttcagtagagacggaatttcgccacgtttgccaggctggcctcaaactcctatagtttcaggtcataactttttcacatgtatttttagaaaaaaattttaattttaatttttatgggtacatagtaggtaatactaagcctttcacatagctcgagtttatttttatatatggtgagagataggggtccagtttcattctcttgcatatgacaatccatttttcccagcaccatttactgaatagggtatgctttccccagtgtatatttttgtcaattttgtcaaacctcagttggctgtaggtatgtggctttaattctgggttatctattctagtctcttgatctatgtgtctatttttataccagttccatgctgttttggctactgatagccttgtagtagaattcgaagttgggtaatgtgatgccatctactttttttttttttttgcttaagattgctttggctattcaggttccacaggttgctttattggttccacattaattttaagatttaaaaaaaaatgagaaatgacatcggtattttgataggaattgcattgaatctgtagattgctttggataccacagtgcatatttttaatgccttttcgtcattgtgcatgttgttctttaccctgacattcgatttatttcttctttcttctctcaaaatcttaatttttttcgggtctagactgcatgttatgtactttcttattattttttatcctgcaagaaaataatttgctttctcatttgtaatctcacagcattttgtttacataccactaaagttcttattatctgttttgaatctggtaattgtccacatcttcctacaagatgaggagttcttcaggggcaggagctttatcttaattcatctttgcaactttcatttcttagttctctgccagacatgtaataagcaatcattctggttgaagagaatcgagttgaataactacaaaactgtaagtcaaaccatgtcactcctctgttcagaaacctgcagtggcttccatattgactcagactaggaactaaagatcttatagaggtcccctctctgtcccaatacctccctgactccatgtcttaacttttatcttccttattcattctgttccagccaaactggctctgtgatattcctcaaacatgttcagaatcctgtctttaagagccctttcttctacctgaatgttttcccgtaaacattcatctggctaaaccccttgccaccttcaggtctctactcaaacgcacctacttcctgaaacttacccagagtccatttttaaaaattatagccttccttcctactcccagctctctcaatccctctgattctactctgtttttcccattaccactgcatgaccttctaacacactatgtcatttaactttttatcatggtattattttcctgcctcacctgatcagatgtaagttccacaagggcaggagtatttgtctgctttgttcattgttgtgttccatgaccttaaagcaagatctggactctgctttatgaacatatgttaagagaactgaatgaatgaatctggtttttatcccattttctagttcagtgaatttgtgatgtctgtttgtcacagtatttccatatagaacttagtaatatcagggtagcttttgttagttttcattattgaaaaattgttctctgtacttcagctcactcaagctgtgaaagcagtgaaacattgcatcaattaaaatattccaattaacactaatcaagaggagcaatagtaataacatagctgaaccaggttgttgaatctttgtagcctcacacatcactgtaggcacagtatgtcaattaaataagataatttttccctattatgcatcttggtaaaataatgaagatattctttggagaaaaataaagcattattaaaacatgggtccctgttttaaaatagcatgcttctgctcttcaatccagtatagcattgcttgtatcattgtcgtgattaagaataaaatttcatggcatgtctactctgtcagacagtgaggtaggttttgggagcctaggaaatatgagatgttgtttttgccctcaaggagattgtagtctcccctgaaagtgtttttttattctggtcctagataatgtacttattagaggtttaattctaagcaaacctcttaacttttctgagtttcaaatattttctacaattaaagtttatacttaatgccatccatgtctgcttactgagatgttttcttaatcaaatgagttattagtaaaaatgttggagttttctctatttgctaaaaataagtactataaaaatgtaaggaaacatatcattattggtctagttgctgctactattattattacaactacttctaattttgttcttgccattattatcattttaaattattattgttaccatcattatcatctttttcataatcatttttatgcctgaagcatgggctaagacactatatttaccagtaacatgtatccagtgcccaccaagtgcccatccctgaaatttatcgataaccctcacatcaatccttttggagtctttgtggtcatttgtggacttgtgaagagcagcaaaatatttaagtcacccaacacttattttcccagctgaggttgaacaaagtgacactctgccttctcgtttgagctctaggtgtacaaacaagtgagctttttgctgtctgtttagtggcacgttgttttgccttctttgcttttttgttggtgatttcactgtttaaaatagcccaagggaatagcaccgaggtgctgtctagtgttcataagcataagaaaatcgtgccttacagaaaaaatacgtgtcagatgagcttctttcagaccacgaattcaatgtcaatgagtcagcattatgtattaaataccatgtcttcaaacagaaacaagtaaagcaaggttatgtattgattggttgatgaaaatggtgtgaccagagactcgcagaaacctaaccctgtatttcccctacggtttagcagtcactaattcagtgcttggggcaactttgcagagaacataactacagccagtaatgtaaattgactgtagacacccggcagtatggtgctgaggctgaaagcaattgagaacacaaattgtcttaaatgacttgacttaaatgagaacacaaaactttaatacttttagaaaaaaaaatgtaggagaatatctttatgacttcaggataaagacgagtttcttaagtaagaaattaagaatgttagccttaaagaaaagactgatgcattcataggactgtcgtttatcaaagaataccagagagtgaaaaagacagagatatagtaggaaaagatatttgtaaaaatgtaacaaatagaggttcccaagtgaatgaagaactccaatgagtcagtaagaaaaataaaaatcctttatataactgggtaaatgatatgaactggcattttcagaatgattaaatgtgaatggcccataaatatatgaaaaaccaactttattaatcatcaaagagatacaaattagaaatcatgaattatcatttcagacaccagattgacataaactaaaatagtaagtattgttgaggaacaacaggaattctcatttagggagaaaagattgaaaattgtcccagccattttagaaaacagattgtgtaaatatcttgtgaacttataaatctaaacttgtattttccactcttaaatatacaggctgtagaccaaagaaactcttgaaaatatgtgtaagacacaggctttttatatcagtttagtttataatagcaagtaagtgggaaaagaactattgatggacagtggaaagaatatattaactatattaactgtggtaaattctttttttttttttttgtttgagacagagcctcgctctgtcgcccaggctggagtgcagtggcgtgatcttggctcactgcaacatccgcctcctgggttcaagcaattctcctgcctcagcctctagagaagctgggattactggtgcctgccaccacgcctggctaattttttgtatttttcagtagagacgagtttcaccatgttggccaggttggtctcgaactcctgacctcaggtgatccacctgccttggcctcccaaagtactgggattacaggtgagagccaccaagcccggcagtaattcttatgaagaaccgttaccacacaattaaaatgaatgaaccacagctacacccattgagactgagtctcaaaggaatcatgttgagtaaaaatagcaagtgttagaggaatgcatagtacaattccatttttatgaagtagaaattaatttcaaggctgaacaatacattatttagggatatatatatatatatgtctgcacacacacacacacacacacacacacacacacgtatgataaaaaccataaagaaaaaacacatgacaaacaaaataatcagcagtgggggtatagtcagggaggaatacacagaagcttcaacattactggcaatgcttcatttgttacagtgggtgttaggatcacaggtgtgcactttagtattcttgtaactctgcataaacattatttgttttctttgtttgcctaatatgtcacacaataaaaaatttaaaatgaggaaaaaccatcaggttatctggagcaagacagcctgggttagtattctggcattatcgtttactaacaatgtgtacttgagcaaattattttgctgttcagcaatcagtttccttatctataaaaaggaatataaaattacccactttagggattgttcagaggattcgattttatgtattgttaatatgtgaaaaacacttaggataatgcctagcacataggaagaactcaataaatcttagctctaaatactactattcaacctacaagtggctgaattagctaacatacaactaagcaaggaaggtgtgagcattgctcttctatcacttgaggaccaggatacctcatctgagatctggaatatcttcactagctcacccaaccacacccacatattttgagcactttttttttgagacaaggtctctctgtgttacccaggctggttgcaaactcctgggctcaagcaatcttcctgcctcagcctccaaagtagctggaattataggcacacaacaccatgcccggctattttagggacactgaaaagtgtctttatcggccaggcgtggtggctcacgcctgtaatcccaacactttgggaggctgaggcgggcggatcacctgaggtcaggagttcaagaccagcctggccaacaaggtgaaatcccatctctactaaaaatacaaaaaaatttgccgggcatggtggcaggagcttgtaatcccagctacttgggaggctgaggcacgagaatcgcttgaacctgggaggcggaggttgcagtgagccgagaccgcaccatcgcactccagcctgtgcaacaagaacaaaactctgtcttaaaaaaaaaaagtatcagttgctgcactgtgtagcatcctgatcactgttgcttcatctacaatcttttaagaagcctgtggcaattcaagtgccacatgagctttgtagctgtaaagtttcttgtgatagaagagcaattggagttgtgctagaattcagttgctgaaaactgcactaggaaagttgcaaggcaaagacaaacccaaagaaatcagaatagaaaatgatctcaggagcaatgttgtgacgatggaaagatgacaggccagtgctctgacatggaaaatgagaatgtagctggatattagcttggctcatatttttgaaacccagagcatgagtagtctcaatattgatagcctgggtttgagtaactctcttaaactcacttgatgccaaagctctcatgagaatccagttgtgccttgtggtgaggtgaggctgtaccttggcactgtctgtgcacactgacctgcattgaaaacaatgggggcagtgagcagggccgaggtggagattgagaggaaccaggtcgtggatgccaaagggggagaaattggccaggtttttatcccggaagctaaactgaaaactcaagtcccttgatcctcattgttctgggtccacagtctgtgcagatggaatgttgattgggtgatcaccgccagcaaaaagtacagactgttttttctactctcataacactttttgttttgttttgtttttgtttttgtttttctgagacagagtctcgctctgtcgcccaggctggagtgcagtggtgagatgtcggctcactgcaagctccatctcccgggttcacgccattctcctgcctcagcctcccgagtagctgggactacaggtgcccaccagcaggcctggctaattttttgtattttcagagagacgggggtctcaccttgttagccaggatggtgtcgatctcctgacctcgggatccgcctgcctcggcctcccaaagtgctgggattacaggcgtgagccaccgcgcccagcctctcatagcactttcttatactctacagcatttactctaaacacttttacagcaatgctctacatactttctttacaccttacagtagagccactgatgtgcgtatcatatctggattgtaaacgtcttgagatcagggaccatgttggattcatcttcacattcctcacaacatcttccacacatggcaccacaagtaatattgacgaagggagggctgtcaggccgcacaaaggatggtaaggtcttcctaactgaaatcctctggcttcctaggatttcagaggcagaaaacagtaactatccatcgctgacacagatgatcaccatgctagtttgttcattgtcttctcttatcaaatcagtgtggatttcatatgtctcctcagttgtttctcccacttcttcagcagcttagaagttttgttttgctggggagctgtttttaacttttagatataaggtgaaaatgcttatttattagtttcctcaggtgttacatgaactaagatgacttccacatcagttataaataagaaagtaccaaactaaatcaggactgctgtgtcacttggcactacttcacgtccttcttggcagcctcgatgggggacgagagctgagttggcaaaggggggagtgatttatcctcccacacttagaagtaggatggaaagcagaaaggttctacttttatattacttcttcttttcaaattttcatattaacatcccctatccggtttctctagcttatttttctgtagtgggcatcaacgacactatgtgtgatttgtttattttatttgtcatctcttacccacattaagctctttgagaagagagatttttgctttgttttgttttgtcagtgatatatccccagtgtctaaaacagtggctggcatcatgataggtgccgatagtaggcatactgtaggtactgaatgaatcttcgttggttcttaactaccacaaagtgcacttaagagcaaggggcatgagcaatggcatttctaagaactgacaggtttaacacacggcagccttatctctgattcttctttgtgaaaatgagaacagggaaacagcacccattgcaaaatctaaatcgatgatgaatgaacacgtagcttgcgtgtatatttgacgatggttttattttcaaaactgtaattaaatgagataaaaatatatggttgaagttgccgaagcaacttaaattcaacataaataacagctgctcctcatctgggaatttcatttatatacagaacttttttttttttgcccttaaaaatttttaactggtatacagctaattcagcatccagtatcccaagatacactttatactcaaagaagatggaaaagagaagagaaacagccctcgttgagccagtgatgaaacaaagctgttactccccatacctttgatttccctaaaatagctatgatgcaaagcatgtccagtttcttaggagcaatgagtctaagcatgactggcattttttaatgagtccagcaatccctactttaatagttcaaaatcctgaaactgagtacagagtgaagagtcttctattagctttgaaagcaaaatttttctgcagagcatggatgccaggaagtactgataacatctgcctctccttgtaaagtaaggatcagtgcagtttcctcccaagcttcttggaggaaaaaaatacctactctttggatagaattaagagaaggtataattacttgaacatcgatctagtttcatttgcgagtaggaagtgagaaactgcgcctctttcctgagacatcgtatccactaccactaagtgctaggcaaatttggtagtgagttcactgcctcggtttatattcctgaaaggctaataaaagaaaagaaattgaatgaaaaagtttgagatgaagagatttctttcactttgaagcagggtttttcatgaccaattgtatggctcgtagatttgtagtctctggggtttgatcatgaactgtggtccttatgtctccatttagtaatatgtttccaaggcttttctgtagattactgactttatcatggcctcttgatgcataacttttcagcattttcttcagagaatattcattctggtgttacttgaatgtatctgatttgccttctaaggtgcctatttattaagaagattggtacaatgaattacaacctgctaattttaattttcattggggagaaaaaaaggctataaagtaaaattcaaaatgaagaatcatatttctttctgtcaaagctataatgagcataagtctatcagttataaaattatcacactagatgaagaaaagataattgtatgatatatcactgactggctgataacagccctaatcacaaataataggcccatgcaatttgcaaggagttgtttcatgttttcatcatctctggcattccctggggcaggggtgagtgggcgagtgggtgggagagtatttattttgcaaagcaataactccagttcatatgttgattacattccaattttaatttatctcttagctttccacttaaggatggggatgcgggaaagtaggtggctccatgcccttgattggacaccttttcttgaagttattctccaaagcttccctggctattgagcatacaaaggtcctttgtagccaagatgctggaaagcagtgtgtcatgaggacaaatacaagaaagttcaccctagtccaacaggtctcaccaaccaccacagcctgtgaaacaggaagaacagcagtgctcaacaagtactaattaagtatctactatgtatcagacactgttttgggcattggctatagcctcataaaaactggcaagattcctgccccacagtgagcttttatttggggaggcaatggagacagtaaaaaagaaagtacacaaatgagaaccgtagttgcagatggcggcggtggtgatttctgggaaggatgtagtaaagaggggatgtgacagagagtaactggagtcaggtcacggttgactttacttaagccctcaggtaatgctgctctgaagaagggtcatttgagttggttcctaaaggctaaacatgataagccaaagaatggggaaagagcactccaaacaaggggaacagcaaggacatgggtcctgagactgggttagctgcaaggtgtttgaagaacagaaagcaaaatgtggccattacggtataactaagtaaggagggaagtggcagggagcaaagctggggacgtaggcaggggctggatcctgaagggcctttgcagagcacagtgaagggtccatattttattctgaaattgaccaggccaaatgccttctgaaacctttgtttctctttgtgttgtgtaagtatgaaaccaaagataaagaatgcagctgcctaaccattaacactcctgagtcaggatgatatgagaaaagagatgagctcccgtagagaaaaatgctggtaataatagcttgcatgttagggcacccgtctccgaaggagaacaacattattaacggtgccatatctcactaattgtagtaacctcatgagttagataggtgtacttttttgtggaacacacagggaaactcagacattttaaattaagttgttctttggcctcttaaatagcacaaaggtctagataaaatagagtatgtcaaagaaatgaggaaaaggaaagaactaaaatgagaaataaaaatagccatcaggaacgctgtaagctcccagagaaaagggcagccaagcaacgtttattttctgtaaagtcaagaaaataatagttgaggggtgaaaaactgtgagagtctcagacagtcaaacagaccatcaaaaagtatggtttcatccctgttatttaatttgatatagaatagaagttatatatagggacttctgggtcgggaaaatccggattctaatctaagctcttggatgtttatttttctttctattaaatgagaatagtaatagaacccacctcaaagagtcgtggtgaagaccgaatgaataaatacatagaaattgagaaattgtgtcatttagctaagctggatggaactggccttagcattcttccaaatagataatatttataaagtggttaaattgccaaagttaagaagccttcttaacatgtaatattgattatgctatttttaattcttgcctaggttttgttcctggaaacaaagagtgatatgtgatctagtaatgtggtgcaagaagagaaagaggagaataacctccaattttgctaaatagaggattgctgaccctaggcaaatttgtctttggcagtctccacacaccactttcctcatccagttttttaagtcattatccttcttgaactttctcagcgctattttgccttctccactatttcatagattaaattttcctttgattcttctttggttattcaaaactcacatttgaagactccatactgctcttacttacttgttaagtgaaagcaacctgattgaattaattcactcttcactgaaagtgattaatagcaaggtcatacttttgaagaaggtatttatggtttaaaatgatatttttgtaattccaaagtaatatctaaattgtaaggttttatttggtatgaccgaagagggtgacaaaaaactcaggcagttggagagagaacactgtgagggctggaatcagcacctgggacagctctgaataagctttcccttttactctgaaataagtgtattaaggatttccatagtgatgttcatggctgcagaattagaggctctgaaaaaaaaaagaaaaaaaaaaagatcagaagtcatttctgtgaatgagtcatttgtatctcaagggtacattgacttaggaatattagacctagcataagattttggtcccggccaggtgcggtggctcacacctgtaatcccagcactttgggaggccgaggcaggcgtatcacttgaagtcaggagttcgagaccagcctggccaatgtgggaaacctgtctctactaaaaatacaaaaattagctgggcatggtggcaggtgcctgtaatctcagctactctggaggctgaggcaggagaatcacttaaacccaagaggcagaggttgcagtgagctgagatcacaccactgcactccagcctgggcgatagagcaagactcagtgtcaaaaaaaaaaaaaaagttttggtcctttactttatttttattttattatttatttatttatttatttatttgaggcagagtctcgctctgtcgcccaggctagagtgcagtggcctgatctcagctcactgcaagctccacctcctgggttcacgccattctcctgcctcagcgtcccgagtagctgggactacatatgtgcccgacctcctagtcccttactttcgactgccaacaaactggggtaattaatgtcaggtttttgtttttgtttttagacggagtcttgctctgtcacccaggctgtagtgcagtggcgcgatctcggctcactgcaacctccgcctcccaggttcaagcaattctcctgcctctcagcctccagagcagctgggactacagcacatgtcaccatacccagctaatttttgtatttttagtagagacagggtttccccgtgttggccaggctggtctcgaactcctgacctcaagcaatctgcctgccttggcctcccaaagtgcggcgattacaggcatgagccactgtgcccagccaaaaatcacatatatttacatcctttaaaaaaggtaaggccgttatcctcagcaaattgacagaaaacgaaataccacatgtcctcacttacaagtcggagctaagatgagaacacgtggacacataaaggggaacaccacacactggggcctgttagagagtggagggcgggaggagggagaggatcaggaaaaatagctaatgggtactaggcttaatacctgggtgatgaaataatctgtacaacaaacccccatgacacaagtttacctgtaacaaacctgcacatgtacccctaaacttaaaagttttaaaaaggtagacaaatatcaattttactgttgtatagaaacaatatttttaagtaacacaagcattctcagaccagaagattataggaagaatttctcatgaagaattatctgaatccagggtatagtgcgtatatcttaaatataagtgttataaagaatacagttcatgcaatataaaggataagatatctgattcacttcagcatcaatcttgacttgaaagcataattaggactagcagaagaggatatattttaagtcttatcaggtttgttttttttgttttgttttgtttttttgtttttttgccacagtagtgttgacttggccactctaatgttactttatccggtggaagttctcccagtgagtcactttctgtaaactttcctttggatgctcaaaagtcatactgatagtgctaacatttatagactactgactttggaccaggcagcatcttaagtgctttacatgcatgatcttaatcttcagaaagtcctatgagacaggaattattgtcctgacattagaagtgagaattgaagttcaaggagattaactaactcacctacatcatacaggtagaaagtaagagtgctaagtttgtactcaggtccttctgactccaaaaccagggtgttaaaccatcaggcagttcttcctcttgctatatactctcttacagggaagtccagtcttccttcttcctaaatggaaagaatgtcaaaaatacgactttgaaactcaggttttgtaaatttcgatttattttcactacaagtctcttcaatccaggaaaccataaagtgtgcatccacacacacacacagggagcaaatggcagagagtcaagacataactttaaatttgctgcatgatagtgagtttttaaagttactctccaaaaatacttctttttataaatggtgcagtcatcattatggagatcatattcataacaaatgtatcacttgaccatttttccaagttgatgttcatctccttactgattgcgtcttttaaaaggaagcaataacaaagggaactggtgctgacaatttcttgttctaaggccaacctgggagaattaatagaatccaggtctacccaagtcaggaaaaaagtgaattggtatttttttacttgcattaaataatacatgtattacatgcatggttactgtatcatttttcctttttttcttttctcccttctctctgtggattcttaacaaactatgatgtgtgatattatctcattaacctttcctggccattttaaaactaaactttttataccttcctctgagtcatcccaccctgtgaatagcttcagctcttcctgtccatatgtgtaatggctagtccattaattatgacctaaataaattactctttcttatttactgttattacttctcaaaagagatcttggaccctcttgattttatatcctctagactataatcaggtatttatggtaagatacttcttccccagctctaaatatttaaaaatttcccagacaaaaaatacgtggacattttccccttgctctctaatttactccatggcctgaattccaaatgttttcctatattaagactttttattattgatagcatattgcagctttaaggcttttgtacacgtccactcctccaggaatgtaactgctaaatcacttcctctctggtctcaatgaggtaacacattccaaatactatagcatgttttctaatctcattttaaaatgaaattcaggtattacattccataggagaataaaggacagctgttttcacaaatatgatatgaaaacacatctgccacacaattgtacaatccttagcacatggctgttggaaaaagttatgtaaaatgctgacaaatgaaatcaacaccaaaaagtagaggtatttattttttaaaaatctacacatcacatgtcaatgaaccacatataaagcttgaaagacaggctattttgagaaacaatggtgcacggatgttaattccttgttttacatacacattatttattcaatactatctttggtgaccaattgctaaacggaatacaagccaagtgtaattgtttagctaccttcctaacaaggcagcaatcctgcttcttaatagagttgtttctgtttattttctccttgttcaacttcacactttgcacctaacatttacaatctccatgttgagtgcccaaccacaaagaaaagcagaggaatagaagatttgaaaccaaagtacttataccaacccatcacactatgtgttgaaatgtggatttctttccatattcactgagtgtaaatgttatttaaatgaacgtttttgtgtcctggcatggcaagtaactgatttgaaagctctttttcactgactttacgaaatcagtgaagatgccacagattatggtgcttcagagcagtaactttggagagagacaaaacatgagtttgtatcttctggccacttcctaggcacgtgaagaaggtgctgcacctccgtgagcttcagctgtgtcacctataaattgggagtttaaagtgtaatggaattcaatgagatcaaataagaaaagtacttggccacatggtatgactgcaatatagtctgcaagtcaattctattgttgctattagtgtgatggccacagtgacagagcattatccataatgtatattccgtctcataatgcctgctgctactgatcattacccaagtaccaaggctttggagataaaatgactctggatcctcatctctcaccttatacaaaaagcaactgaaaatggattaaggacttaaacctaagacctgaaactataaacattctagtagatgacattggaaaacccttctggacattggcttaggcaaggatttcatgaccaagagaacccaaaagcaaatgcaataaaagcaaagataaatagctgggacctaattaaactaaagagcttttgcatggcaaaaggaacagtcagcagagtgaacggacaacccacagagtggaagaaactcttcgtcatctatacatctgacaaaggactaatatccagactctacaacgaactcaaacaaatcaataagaaaaaaatcaaacagtcccatcaaaaaagtggactaaggacatgaatagacagttctcaaaagaggatatgcaaatagccaaaaaacataggaaaaatgctcaacatcactaatgatcagggaaatgcatatcaaaaccacaatgtgataccgccttacacctgcaagaatggccataatcaaaaaacagtagatgttggtgtagatgcagtaaacagggaacacttctacaccactggtgggaatgcaaactagtacagccactatggaaaacagtgtggatattccttaaagaactaaaagtagaactaccatttgatccagcaatctcactactgagtatctacccagaggaaaagaagtcattgtttaaaaaagatacttgcacatgcatgtttatagtggcacaattcacaatagcaaaatcgtggaaccaacacaagtgcccatcaatcaataagtggctaaagaaactatggcatatatatatatatatatgatggaatactatgtagccataaaaaggatgaataaacagcatttgcagtgacgtggatgagattggagactattattctaagtgaagtaactcaggaatggaaaaccaaatatcgtatgttctcactgatatgtgggagctaagctatgaggacgcaaaggcataaaaatgatacaatgaggccggatacagtggctcacacctgtaatcccggcactttgggaggccaaggcaggcagatcatgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccaggaggcagagcttgcaatgagccgagatcgtggcactgcactccagcctgggcgacagagcgagactccatctcaaaaaaaataaaaaaaataaataaataaaataaataaaaaaagaatgatacgatggactttggggacttagggggaagagtgggaagtggggcaagggataaaagactacaaatatagtgcagtgtatactgcttgggtgatgggtgcaccaaaatctcacaaatgaccactaaagaacttactcatggctggacacggtgactcatgcctgtaattccagcacttttggaggctgaggcgggtggatcatgaagtcaagagatcgagactatcctggccaacatggtgaaaccccgtctctactaaaaatacaaaaattagctgggcgtggtggtgcatgcctgtagtcccagctactcaggaggctgaggcaggagaatcacttgaacctgggaggtggagcttgcagtgagccgtgatcacaccactgcactccagtctggcaacagagtgagactctgtctccaaaaaaaaaaaaaaaaaaaaaagaacttacccatgtaaccaaataccacctgtatcccaataactgaaggaaaaaaatttaataaataaataaaaatatatgtggaaacattgctggtaaaggcttaatcatgagtgtacaaactttgacataatacccatttacacacatagctcttgacttagaaaagtatcatgttgttaactgttaggatctggatagatattcatacctgaaaagaacaatttgaggcatgtaatctttccctaaacatgtgcataagtatcatgtcctttgattcacatctacagcttgctctagtgtgcgtttgctattagaaacctttccttagttgcaatgtttgggatatgctttggcactaaatcacagcattcgcaatggacagaagaaacataatgactacatacttgaaacaaagaacattcattctcgttacatttatgagaaaattaagacctgcccatggtatgtagacctgcccatggtcaacacagctaataagtggcagagatggttttcaaactcagatctacccaaatacagtctttccatttgctgtataggtagggtttatcatctggaatctatttcaattaatgactaataaacgtttctgattattttctcaaataccagattaatgagatacacttcaaatgcctaaaacttgtagaagtgaatgaattcataaactaagaaggaaaaaacatgaatacagttttttaaagctcaggaaggatagttaaaaatcattgcccatatttctcattttctttctcatttcttaatactatttctctaatcagaaaccatgattggttttacctagatgatacgtgatctctactacctatcagctcttaatttttcatgcaactctggaaattgaatgggatatctgtgcacaaatgtagatgacttactctaagaacctatatgcagaagtgacaattcagactgattcagtgttatttttagggataatggtttaaaatattaactccataacacagtttttaaaatcctggtttaattccttttgaaggaatctcagaccatttccataaagacaagaaaaataccatgttctaccctcacctggtgtccattgaataaaaagaagtttattacatcagaaatgtaattcaaatcatagcactgatttgttttgtgcagagtatgtgtgtgtccttcatgttcacttttcacagcccaaacctggcagtctttggtttgctctgattaggtgttatgtgtcagacctgcctgcttgagccccaacaggacggaagctgtgttctcacaatgcttgccttctgagttggcaaaatcagatggtacttaatggagtttttatgaatatataagtgatgaagacaataatgtacaaacttaaaatgtccctaattccagaagaatctggtaattaagacatgtctatatgtaactttttaaatatccttagcactccttgaaactaagcctgagtgtagaaacattccaatttgtaactgcagccttcccaattgttgttaggagtacatgagataatcatcataaaatacttaccaaaatggccagcatggaggaaatcatccacaaatgttactctgctctagtgtgcacagccagatggtttgcaaccctgcacaacatacttgaattggaagtccccgaatccaataaaatgttattaaatcaaatgtaatagacaacaaaaaacgaaatggcacttaacacactccttattgagaggatttacatctgggagggtggaagaaaaaaacgtttcttgaacaataatatgtctcactttattagacatatttcttatattaactcatttgtatttgtaactgcctatttacttatactgtgatctttgggtttataaatgtcttatctctctaaccagacttgacctttttgaggtaataaaacattcttctaaaaagaaccatgaacagtaccttctaaatatttcaaactacaccacaagaactttaaaacaattgtgtgtctgtatatatgtctatttatacattttatatagagttgtgtttgtatataaagagagacagtcacactctgggtatatatggagagacaagtataattatatatgatagaatggtttgtgaagtgaacagaattgtatcagaaaacaagagtttgcattctgataatgatatttaaatacagagaggtcttgggcaggtcacttaacatctttaaacctcagtttcttcacctagacctgcactatccaatgtgatgtcctggcatgatggaagtcttctgtgtctgtgctggccaaggtgataatcactaagtgcatgtggctactgagcacttgaaatgtgactagtgtctgaggaactgaattataaattgtatttaattttaattattttaaatctaaataggcacgtgtggtaagtagatattttagtggacagtataaccataaaatcaaggaggatgggacaatgtcatatgaaaagaagctctcctgaattcccccggtatgggtgctaccaacgcagttttgagcagaatgattctcttttgaaatagtggtactctcccttgatatcttaggactttaaagtttaaatgctttttcccatatttctcccaacagatcttgacaactttaaaacaagaacaagaagcactgtgtctgtccgtcgaggtcaaggaatggtgctactgtgtggcccgccaccccattctggaggtacatataaatgaactgacatatgcatgcttcactctctgttatttttcttcctcaatgttctccctcctgacaccagctgagtgcacagtgtcatttatagagattcccaaagcccctccatgtggaggaaaaaccacggtgaatgcctcccatcattaggacaggaaaataccagattgtgcaaattttccaccccactgcagtgtacctggcacaagaagaaagacacctgagtcgatcaaaatcataatgctgttgcttggtaaagcagtgtaattaaaacgactcatacttcttacaacttgattgggttaaaaaagatggccctacttcatttcatctcctggttggtctgggaactgtctgtgaactgtgtctactcgcaatacttctgacaccaaatgtatgggttttttccacactaacaaccaagtctccaatcttctggacaccaactggctgtccaacgattcaattccattttgacagtaactaccccattaactactctgggatggttagtgtcagaactcataggataaaggctcagtcccacaaggctgcctccacttcagatgccactttcaagtccttgacctcacacacttctgactaactggctataaagtgggactcccataactccctccttggcttccataatttgctagaatggttcccagaactcagggaaaacagtttacttacataccagtttattataaaagatattataaaggatacgtatgaacagcccgataaacatatagagagagtgaggtctgaagggttgtgaatgcaggagtttctagacttgtggatcctccccacatgtagatgcattcattaaccctgaagctctccaaacgctgtcatttagggtttttatgcaggttccgttgtgtaggcatgattgatcgaatctatggccattgtaattgatggccattttccagcccttctcccatccccaagagtggggaatggggaggctgaaagttccaaccctttaattatttggttggttcctctgacaaccaatcaaggggcctcaccaagagtcacctaattagcataaactcaagtatggttgaaaagggcctatttatgaataacaaaagacattcttctcagcaatatcactcaggaaattacaagggttttgggatgcagaccaaatatatatatttcttattaatcacagtatcacaggatcagaccaagaacaaaagttccttgaccatagaatctacgatcactttgtggagactcatagcaactagatcagttaggaatgcacttgactgcaactaactgaaaacccagctcataatgttcttttatattctttttctcacatgcaacattttctctttcttttttttttttttttttgagacagagtctcgctttgtcacccaatctggagtgtggtggtgcaatctcggctcactgcaacctctgcctcccaggttcaatcgattctcatgcctcagccttccgagtagctgggattacaggcacccaccaccgtgccaatttttatatttttagtagagataggatttcaccatgttgaccaggctggtctcaaactcctgacctcaagtgatccacccaccttggcctcccaaagtgctgggattacaggcatgagtcactgcacctggctggcatgcaagattttcaaagatatacaatctaaagctagcacagcttctagaggatgtcttccaggactcatgcccttctctgattcttctctgaagtgcttagcatgtggtatggatgaggcatgaagtctgcattccaaaccagatcaaatgggaagaagcaaagacaaaaggcaatgatttgtttttgcttgtttttgtccatttcaatttacctttattatcgtaagttttctttgcctgaggactttgcctccatgtcattgatcacctcagtggcaaaggaggttgaaaaatcaaatattttacgcagatgtgttatgccctggaaaatatcataattttactagtaagggagaacatggagagatgtgtaggcaacttgcagtgtcggctaaaaggaactacgatgactaaaaggcaaatataactgcacataagggattcagtagtgtggaggtttaataagtagtaatatttattaggattccactaaggtctgtaatgacaagattgataaactctacccttggaaatccaggctgaagtttagttcaatatctgctattcttgttattgccttaattttcagtttgactttccacatgtttaaaagaacaaacttttagatttggaatttgaaaaacactgttttatttttgtcctctgttcaaaagttgtaatgttttctttctcatctaattctgagctaacatttccagcagaaaataacaattagtaaaggtgctaaaaggcatgtacttcaagcatcctgaatacgaaggagaggtgggagaggtaggttcccctctatgtctggatcagggacaaggaattgttaggatttctggtttttgaagactgacagaaaatctaggtttgatttcagaggtctgtgtttggaaaatgggattattcttcaggatttcattttcctttcaagttagtatcagaagcactgaatttggactctgggatatgagttttgatccttgttctgtttcaaatcattatttgatactgggaaaatatcttcaaattctttatgcctcactctgcctgtctataaaatgaagagattaaaagaagtctctcaaatccctattgattctatcaacacataattataactcgataagggctaaacatcttgtttatcaagtgtgtttgcattattgaaggcctgtcctttatatgagaaaaccacttcactgtggacatatatttagattcaggtgaagttcacttagactaacacttctctttttaatatggaatctgatcaaaataaaaatggaagattttactaatttcttctgcaggctaccttcattgcattaagttttcatcacatggcagcaaccctaaaaattaatcttgtaggtatattaagaaaaacaccaccactgtccgatataatgatctctttaggaaaggcaaaacacatggagtgatgctgtgctgctacgcaatgaagtacctgactactttccctttcccacagagaaatagattaaaaatttccatagacatctactgaaatgcagttgtctctgctggcagcagtcagcagctctgaaatccagttccttgagctgtgctgacattcctgacaatcttgatggtgaaagacaaggaaataaatattcttattataagctctattagaaatggcgtgcacattaacgctgtgggcaaagcaggcacggctaagaaatttttgagaaaagaacaaagaagatattcaaggttataaaagagcatctcagacatccatcagttttggacaagggaaacaatgattatctgatgaaatccttccaatttctcaaaagcctccaatgcaactgaacggcagtgattctctcactgtttttccgggctgtgtgtcaccctaaagcgagaagaatcactgtgagctgctggacatactgagcattttagacccagcatatggtctcctggtttccattgtaacagatcatgcagaggaagggaaatgagtcagccttttattatatcagtggggtactgagtaatggcatgaaatccattgtaagggatgctgcatgtcctatttcgaaagctgtgcggtgtcagaccttcttagggtagcagagaaatgagcagcaattaatctgttttgaaaagcatttcagtcagcaggtatttccagcactctaccaatcactatgtgtggcctctttgtcatctcttggtttatatgtatgaattcagatgtgatggttttgcatagatttttaccattaaatataagaaaacaccaaaaaatagaaatcactttgatggactctggctatccttggtgctccttcctattagacacagaaattattgaggtccagaatgtccactttgctttctgccaactccagggtcactgggcaccaggaattcatgacctttaaccaagctctcgttaaataggaatagaacagaggaactttgagattcttccttccaatatacgaaaatttctagtttattcctcaataaaatcctcacaaactgttcatcaagagaggtttttgttcatgccttcattttatgtcaccaagatgcttgcgactcaaagggtggtccaagcaccagcagcattggcctcacctggaaatttgataaaaaggtaaaatctcagaccccactacagcctactgaattggaacttgcattttaataagatctccgagtgatcatatgcactttgaagtgtgagatgccctgagtcatagctgtggttcccacgcacaccccacctctgggcagtgagggttgacagcttgagaatctggagggaaaattgttaaaaccataggtgtccaacctgttcacaagcatattccgattccataaatctgggctagggtccccaaggctgttaaaaaaaaaaaaaaaacaggccaggcgcggtgactcacacctgtaatcccagcactttgggaggaggccgaggcaggtggatcacttgaggtcaggagttagagatcagcctggccaacatagagaaaccccgtctctgctaaaaatacaaaaattagtctgctggtgtgcgcctataatcccagcaacttgggaggctgagacaggagaattgcttgaactcaggaggtggaggttgcggtgagtggagatcgcgccactgcactccagcctgggcgacagagcgagactctggctcaaaaaaaacaaaaacaaaaacaaaaacaaaactgtagctgactcgctcactctgaggcagcaccagatttaaggtccattcacacggatcatctacagaactagcccaggtccagccctgctgagatggagtgcttcgatttccacatcactcaagccgaagggctgagcattccttatgtgaaatttttatttaaaataattcatctatttacttattttttgaaatggagtctcactctgtcaaccaggctggagtgcaatggcacaatctcggctcactgcaacctccgcctcctgggttcaagctgattctcccacctcagcctcccaagtagctgggattacaggagtgcaccaccacacctggctaatttttgtatttttagtagagatgaggtttcaccatgttggccaggctgatctcaaactcccgacctcaagtgatctgcctaccttggcctcccaaagtgctgggattacaggcgtgagccactgcactggccaattgaaaataattcaaaataaaatgtagttaccttaggctttagctttgactttatatgtttttgttcataaaggaaatgaaaaactaagaaaagggtggcttttcctaggtactcatactcagaagtagcattctggtcaggtgcagtgcctcttgcctataattctagcattttgtgaggccaaggtaggaggatcacttgagcccaggagttggagatccacctggcaacacagtgaggccgtctctaaaaaataatttattttattttattttatttgggacagagtctcgctctgtcgcccaggctagagtgcagtggcgtgatctcagctcactgcaacctccgcctcccagttcaaacattctcccacctcagcctaccgagtatctgggactacaggcacatgccaccatgcccagctaatttttgtatttttagtagagacagggttttgccatgttgaccaggctggtctcaaactcctgacctcaggatccacccgcttcagcctcccaaagtgctgggattacaggtgtgagccatcgcacccagcctaaaaaaatgtttaaaaattagccaagtgtggtggtgtgtgcctctagtcccagctatttgagaggatgaggtgggaggattccttgagcctagcagttcaaggctgcagtgagctatgatcacaccactgctctccagactgggcaacagagtgagatcctgtcttaaaagcaaacaaacagacaaaacccagaagtagcattttctattcagccagctttcctacattgttattggtgaatgtatggcttcccagagtatatttaaaaaagaaaaccacctgattctgattctgcgattattttcattattacgggttttggagaaactagctaaaattttcatctttagatttttcttttacacagaacacatccccactagagttggatcctatccacagggcatcagacccagggaccttcgaacacgaacatctgtagagtcctttatagtgtttatagtgctttaatttatattatattatctttgaatcctcacaataatcccataagaagtaaggacatgtgtttcatagataaggaaatagaagcaaagagattatggagggcacactctaatcaatggcaggaataagagttactgttgcctagaatgcgcccttttatttgtatatagcagaaaaactggaaacatgtactgtactttctgtgtcagtggttctttggcgctcaccccaggtcaattaaatctgagtttcttgatggcaggggatcctctggcatcatccaggtaattttaatatgcagccagggtggaaaacttgagtccctgcattacaaaatcaagtaggacttatcccagcaaaacgtctctatatgcaaacctctccagggttccataaatgtaattttacgtggacatacccatacagattataaccacagcccttaaaagaagcaagcatgcctttccacagcatggttatttcagctggaccatgctgtatttactgtaggacagagataaaagcgtgaaagtaggacatctgtgttctagtcctagctctcccatcaacttgctatgtggtcttgggccaattatgtaacttctctgagccctatttcttcatatgacttctgtttctgtcttcccacacctactcagctttcgttattaagatatcaccttcagagttagactcacccagtttcttacttagtccaaactatgctgacaggtcactgagccaggacgaatcttactgtgctaaaagtgagcagcctctatgcccagaataatcttcaagatgtccacattcaagtcaagttgccaactctgcctaactccacattcaataccttattctcatcttcttccccaaactggttcctgggtttaccagttttatataattttagattttcagctgcctccttagtccagacacttagcttagctgttgtcctcatttcttacccaaaggcgcatgaaatcccattttaaccccactctaaacctccaaccataacatggtattctttgcattctaagtattgcttaagtctaggaagtctagttactgggccccacgcatcatatcagacctccttggctattgacatttgcctggctgggtcctaggtttgtcaactgtgctttggacgactggtcactttcctcaggaagcagtccctgtacttccagcttactccctctactttctctcattacctttttcaggctccctctccttacccatatctgggttcctagcatcactttcaagtcctcaaacaccactataatgccaaccaaattgaattcatctttgttctgtaaacttttcaaatctgttatgaggatgaaaagacataacaaatgtggcagcaatttgcacagttaaaacttccagacactcctgattttattaattaggctgggtttgattgttttcatttgcttaagcttgaagtcaaagttaaatcagagaatttctcatctttggagatatgtgattcttgatttacattcatgtaacaacttttatgtaggcagatacttttcggatatatctcccaagagatttatatggaatttacatctattattaacataaattggttatgctctggcattgtggctttattagccattcttctaacatttgaaaattgctattaaagactttacagttaaggtaaactctaccaatagtcttctcataagccaaaccctgtgtgattctttatatttgcattttctatttagcgtgtacagtatgtgcccggacttcatttccttagaaaaacaaggcactaggtagacttaggcggatgcaggactttaaaaatactgctgaaataatgctgagaatatttttaatagactgaagaatgttgtcttaaacatatttttatatggcagcttaaaaaaagcaaaatgtgagatttttaaatggttacaaaattaacaatcacttaattgtcataaaaagctataagaatagtgctgtaagtattgatcaccttttctggtcatattgggaacatgattgaaggtacatatgggaacaaggaagggcccagcatttcacttgagtcatctcattctctctctctctctctctctgtgtgtgtttgtgtatgtgtgtgtgtgtgcgtgtgtgtataatgagagaagtgcccaaatataatcctagttttaaaaacacacataacaaatgatagctaatggttttaggtcctgagtctttgtttcttggccaccactgagagagctgcattttgataccaatttcatgtcacctgagaagcgacttccctgagagatgccttatcacctgcaagtaaattaaaagccacaggtgtccagtaggttaacactgaccgtcttggaaatcagtgattcagaaaaggtcctgtaataaggcaaaatgtaggatctcgtcatctggtcttggaacttacaaaatgatgtttaaaatgttggttgggagtggcattgaaatactgctactatgccattttccaagaatgttgaggtcagccaaacttggtttaaaccaccttttataatataatttctatgaaacatgcattctgatttccatttcccaacagaggaactttatatattcacttaagtagatatctatctcaattcagaggggaaagcttaacatttagttagtgataggttaatcaacatcatagactactagataccttttttaaaaaaatcaggaattaaatattcttctgtttgtttttcttgtgacaggatctcactctatcacctagtctggagtgcagtggcacgatcatgggtcattgcagcctgaaaccgggctcaagcaatcctcccacctcagcctcttgagtagctagtactgcaggcatgagccaccacaccaggctaattattttattttttgttagagatggggtcttgttttgttacccaagttggtctcaaactcctggcctcaagcgatcttcctacctcagcctcccaaagtgctgggagtacaggcatgagccaccgtgcccatccaggaattaaatattcttaaggcgatcttgtctgttgcctcttgactgtgttcctttgaaagatatgaacttggactcctttatttgaaatgtaatcagccagttcctcccttttttctcttccccgtttgccaatcagagggggttacagcgcattagttgatttaatcagcatagaataatgtaaaacagtttataaggtgatgcctttctgcattcattaagcctcctgtttcacccattgaacagaaaaagagagccacattgatcagggactacttgtgataaactatctgacccacatggcctgggtggagtgtttcgtgtttaggaggataggccactgggagggagtgcttgccctcactacaccaaaggcaggctccacttctctcatccatgagatcatttagctcaaagaaagaatcagcaaaagaagcaaaagggaggaattggggcctggcatgtctacaggagtgacttgcttctcctctaccagatatgacaagaagaagtgaggtggatatttctgatttcagttatctctgaaattggtgaagtatattctgtgatgctactgacatactttttgcctttgaattttcctgtcaactctttttaaaacaacttgaatgtttcatgactatacttttgaatgcctagatgtcaacaactatacacttatgagtagaaaaaaataagttgatataagtaacgaacgtttcctggtcatagaaaaattatagtctttttatagctgagcttccagtttcttaaagtaaccttgtagagaattggtggtctggttttttaagaagagttccctaggagtagtagctacatactttctactttaattctttttttagttctagtaagagagatgcttaagctgtttttacagctatagcaagttcctggccatagcacttagaaatagactcagctacttaataaataccagttaattaaatatcttattgttcagaaaaaaaataataatttggctaaaaaatagcagaaataaatttcaggaaattctttttctgtctccttttttcctcacttgcttttgtgcaaacgtttctatgtgctttattgggcagaaaccaagaacttaatgatgcccctaattacccagcttctctcctgacagttagtttgtgtgtactttaatgataggcactatgtaactgtatttgtggatacacagatttcaattcaagttgagtacatctctattttctttttaaacatccaaaaaaaattaaaaagattatctccaggtttgatccttagaactggaggccactgatgtcagagtaagggccaaacacattagtaccgaaaggaaataatgtttggaaaatgagaatggatccataaggctaaatgatctacaaactgtgatcatttgacaaagctggaccacatgcagagctttttcttttggagttgtcctgtcccagaaagcagtgaaggatgacattgtgttagaacataggttgggacatgaagagtctggagatgtgaaaaacacattacacatccaggagagtgctaccagggatgtactagccagaagagaacaaatgatcaacactgagctttcaacaacatgaatctggctgagcgtttcataaataatccagtggacattcactacaggatagacgggcaccattcttgttttaatgcctgctggaaatataccctgtgaatctcattttttcagctgaaaaaggaatgagtggtgctttggctacatttttagcaatgaataggtattctctcaggtcagtgcattaagcaggatgttacatggaattaagcaggataatgatgcagtacatagaataaggaaatgctgactgagtcctggaaatttggaaatagactctggttaggagctcagaaatcgaaggctcagaaatggatatttaccactctcagggattttgaacctaggagtcttaggcacaaataagaagttgttaatttttctgatatattttttaacatgttcagtttggttttcagacattaggaacaaaataactggaaaaagccaaattgaagaccagagaaaactatacatttaggcaagtgaagttcagtttcacacacaaaggaataaatcatggcattttgtatgagggtaggattaaagcttttgattctatgtaatatcaaaatactgatttaagaggaagtgatttactggagtatctgtatattaatcaatgacaaacaatatggataaaaaacttttcaaatcaatcaaactgattgcagttctccatatccactaatgattttgacatttgcagatatatagaataaatacaaagttccaaatgaagcataatagttttacagagagaccaactctgtctgcattatgaactcaaagaaatgtttaatgtttaattcagagactgagagaatgttcgtgatatctgaagtaggtggtgctgctaacaaaacaatgggcagccactttgtaccgagccaagagagctcttcccatctccagccgaaacacaccctctttttctcccatcatctggtgcaggttaacacattatcacaatcttcactgtcacaattaacccctggaaaggagttgtgtcataaaaacactccataggacttcacaaatccatatggcaggcacagctgggaagacagttgcagttgataacgtagcatttcagaaatatccaaagaatctctactttgtgaagtagtgtggaatttacacatcctctcattccctcaaatcagcacatacactagggaacacctgggaaatgccaagatgcttcagttttaggtgtttgaagcccagttcttatcatttcacgcaaaccagagtatgctttttgaaaagatgaaaggacttttaaaaacaaaaggtggctgatttaaggattatgtttcttccttctccacttactgcaaactgaggtagctatgacagctctctaacattagtacccaaatatgagaaagacattcatgtaccttcttctcttgctaccctgagaatttgttcactgtctctgcaagccagcactccttctaaatgtacaactccagtttacttcaatggacacagttgtgatgaatgaaatttatgattggattctaatggattatgtaaattaggatttcaaggttaaaggaatagatttcttttaaaaagtaaaaataggagattttggcagaacctttcagataccaggccttgtcatagacagggcagatataggagtgggccaaaacaaaatgttttctcctgccatgtagcctacaggtctgctagggaggagcggggtaatgaaatcatcatactgagatgtgtgctcttggttgtgaggtgggggtgagggaaaggaaaacagggttcagtgaccatgtaaaatagaaggacatcatgtggattggggagtcagagaaggcttccttgaagaagtagttctgtggcttagatctgaaggacaagagagtagaaggaaaggaggagtattatagacagaacagctgtatgtaagtctggagtggagaggttgtcaaaagaagccaacatggcacatgagtatggacatggggaagggtgtttcagtttactgtgaaagtggtgactgaagcaatagaaagctccatttttgttcctcaaaatcttatgaaatcaatgatagccagacaccagtaagttggaaacagaaaatgttatcaaattgcctcaaatttaagttttaaaaattgagattctgggagccccgtgcagtcaatttatagaaatggtgggatgcacccattcttagctggtgaaaccaaggctgggatagaattacaaccgatgtgttaaagtcatagagttaaataaaaaataaaatatctacactatgtaaatgaataataaaataagaaatctacactatcatgatgacttgagaaaatacttagtgataaaaaaaaattacttggtgatcgagaaggaggggaaatgtcagacattgcctaaggatgcaaagcaaaacaaaatagaatgaaaatgctttggaaggaacgccttaagaaaatataagaaaatgaatggatgcatctccactgtgcttttggtcaagtacaagaaaacatggattctatgaaacaaagatgccaatgttaaaagagagttgccgccaatgcagattgaggtttgaagggagctggcaatgatgagaaatggaaatattaaaatctgcaatgcagactcagtaaaaagccaaataaacattgtagcaaattgaattagtgataagcatggctaactaggtaagtttttataaagaacataaaatgaaagtataataatcagaaagcttcataaatataaaaattaggtagtaaagttccaacccatatgtaatcaatgtaattggtaaagacaggtcatcagtgtgtatgtattgttttattgtttaatatcatcacatacttaccattccatgtgagttcatcatccttttaatagtaaaaacatattgtactttctcatgtttgagcggaagaaaaaaaattatggtattttttattttaataattaaagaagaaaggatgtttactgggagctgccacaaaaacacttggtgttttatacatggtgttacacacagttccagagatatattcaaaggatttggaaaatttttaaaaaataattccaatgacataactttacttgggttcagcatatgacctgtactcctagtagctcatatattctgttatgtttgtgtatgacacataaatttgttaaatataaacaactgggctgggcgaggtggctcacacctataatcccaacacttggggaggccaaggcaggcggatcacttgaggtcaggaaatcgagaccatcctggctaacacggtgaaaccccgtcttactaaaaagaaaaatacaaaaatttagctgggcatggtggcgggcacctgtagtcccagctactcgggaggctgaggcaggagaatcacttgatcacgggaggcagaggttgcagtaagccgagatcgccactgctctccagcctgggcaacagagcaagacttcgtctcaaaaaaagataaataaaaaataataattaaaaacatatcacaatttttgttaaaaaaataaagaaagcatagatgtaagaaataaaaatgggatatgtaccatctaagttgctagagacaataaaatcaaagaagttgtggccaggcatagtggctcacgcctgtaatcccagcactttgggaggccgaggtgggcagatcacttgaggtcaggagtttcagaccagcctggccaacatggtgaaaccccatctctactaaagatttaaaaagttagctgggcgtggtggtgcatgtttgtaatcccagctacttgggaggcttgaggcaggagaattgcttgaacccagcaggcgaagtttgcagtgagccaagatcatgccactgtactccagcctgggcaacactgcgagactccatctcaaaaaacaaacaaactacagcaacaacaaagaagctgtaatctatttaaccagagactcaaaataaagatgagcaaaaaagcatacatgaagtatagaaatatgacagatatgagtgtgtgtagcttatgaaatataaagaaatgcaacttattttaaatataagagcctcagattgagttaaaaatatgatctaaacaaaatgcaatgatacaaaatacctagactaccaacaaaacagattttaaaaagaaaaataaatgagggcagaattattagttttagaccaagcattattcaaatacaaaagcattaaattagataaaggcaaccttttttttttttttttttttttttgagactgagtctctctctgtcgcccaggctggagtgcagtggggcgatctcggctcactgccagctccgcctcccgggttcacaccattctcctgcttcagccttcccagtagctgggactacaggcgcccgccaccacgcccggctcatttttttgtatttttagtagaggcggggtttcaccgtgttagccaggatggtctcgatctcctgatctcgcgatccgcccgcctcagcctcccaaagtgctgggattacaggcatgagccacctcgcccggcagataaaggcaatttttattattaaaatacacaaaccacaatgaagacattccatttacattattttaaacaccatgaaacatagagtcatagtatataaagctaaaagtttgggaatacaaggagaaattactaatgcatatttgttacttaacttgataggtcaagtcaataaaaataagcatataaagaatttgaataatgtaataatgattggcctttcttaatgtaaacatacatacttatgtattttctctttaagcacttccataaatcctatttcaattgtttacatgttcagccaaaaaaaatttaaacaaaattgaaattatataggccaggccttattttccgccataatgcaattaaataagaaattagttataggtcaattttatacaacaccacaaattttttaaaaaccgtcccatgcaaatttcaaatcacatttctgatacctactgggtcaaagaaaagataaaacccatattaatatatttttcaaaagtgaaaaaaatgagaacaaacatatctacacttgtacaatttatgaaaagtataccctgaaacaaattaataaccttaaatttgttgtataaggaatcctggaaatcaaaatcagtaccttaagtattcacctcatgcaattcaaaggaacatagcacaaacctaggggaaatggaaagaaagaagataaaactcaaaattagtgaattagaaaacagtatatagagagacatccaagaggagctttgagatatgagatattctctccaaatctaatcaagaacaaactagagaaatacaaataggcaaaatgataagttaaaaagagcatataattttctataaaatatttaaaatcatttaaaaaactacagacaactctatgatcatttaaacatccggatgaaatgaattatctattaagaatatataaataacaaaattgaaccaagaaaatgtagaagatatgaacataccaattattatggaaggaattgaaagttgtcaagatttactctctccaagttctctggtctatacattttataaagaaaatattttaaagttttaatgtaattctcttgccaaataatttgtggcacagcaaagacaagatgaaaagctaccagtttattttatggaatgagaataatcctggcactagaacttgacaaagacagcaaaaagggaatgcctctctcttatttatgaatgttggtaacgcttacatagtgggtaatacatgtaggcactattttaaaagttttacatatattaactcatttaacccttacaaaaacctgatttaggtgttatgtattcccattttatggatgagaaaaatacctgagacattaagtaaatatggcattactcaacaattcatgaaaaaacactttaggacatgtatataaaatgagatagaagttttaaaagtacaggtaactcaaaataagccaaaataagtatttgctcaaaatataccatattacagattaaaaatacaaaaacaaaattaaaaaataaaaacataatgaagagtaaaaagatacttctggggtggggggctgggggagggatagcattaggagaaatacgtaatgtagatgatgggttgatgggtgcagcaaaccatcatggcacatatatatctatgtaacaaacctgcatgttctgcacatgtatctcaaaacttaaagtataataataaaaaagatacttctataatctgcttaatgacagccaatattatatttaacagaggacgtaaagacaaacaagaatgaaacaaggtttataattattgggtgatgatacatgaaggttcattataccatgatttctacttttgttatttgtaatatgttagaaaatatatgtaacaaaaatgttaaaagaatggtttctatggttgaatttagtgatttctaaggtggcttccagctcagctcttacatggttctctgttgttaattacctctttttccaaaaaaagcattttttgtactagcctttcggggaggaagatgtttgcattatgtggaggagtttccaccatacatggacacattggtctcctgcaaaccacgtagttcttttattgcttcttttttcatttgaaaatcattccagatactgaagttaaaatagctgtccttgctttcctgcctggagagatgggtatcactaaaaatgcctggattggcagtaatccgctttgctcctgcctggagctgttctgaatctccagtggcaggccctcacggtgttactggggcaagtgtgcagtgacgtgcatttcatctgcacacagcaacggtcagactacttggctttctgcagggaatgaaaaaatacacatataaccacccccgttcccaaatggcactgtagcctagttaagaaaattgcttgagggggagtgcattatgctaagagggctagttcattttcaggttacaaaactttaaattcaagttgacacagcttctattttcatttccatacttatctcaactggggaaatgtggtgtttgtcactaaaaaccagccagtaaaatgtagagggaagatggagagtcagtggtccgcagcctgcaagtggctgtgatctgaaatatgtcatgctttagttggtagcagataccataccaaatttgcttcccactggtagactttctccttttattttcaacaaagtcccatgtacccagcagcaatctttaacagcaaaaatgcaattaatataagtcatctcatcatgtactagcattccagatagctcataaacaattaagaatcgagtctgaattaaatgcagaggttcagggctaagtgtgttacaggaagacagagaatgctgttctgtcagttttgtgaccatgagcagtttcattcaagaaaccacatggaaggtgttccactgttaagtaccacatgtgacctctctggtttgaatatctaagtagatccataaagcttaaagtacataagctttcgtgcggctatactgaaatgtaaagaatgcgaatgaaggcacccattaaaagataaaactgggtaagactaaaattaatcctccataatcctagctttagaaactctcatctttactgtatacaggtatctttaatgtgagttattgagtaagtccaagggctcttctggtcaccctttcacatatagtctaccacattcctattccaatagaagctgggaagcattccaggataaattaattgtagaatcaatttgcttttatagagcatggatgagagaaatattgaagttttaagagtttctgttgccagacttatagaatatatttgccattcagaccctatggtttgtaaaaaaaaaaaaaaaaaaaaaattaagcattttgggtgttgaccctgggttgtgtaatttatgcatggctctggtaagctgttacctcttaatcacccaggagccccagctcttgaagcagactaatgattccctgctgactatctgctctgcttgcagttctgccttcaacacatctgtcagcaccacttcccaaggggactgtatgaaagttgcaaagtctgacatccgtacattaactactctatgactttctccattaataatggactgtcccgccgtaagctgtgagtttcctccccaacaccgaccgcttttgcttttatgtgccactaggcctgtcatcagagagacagccagagaaaagacatctggcatctgtaactcatagggggttcatgaaaactaaagcaggtagattattatctcaaatgaagttcctggaaatactgaatgatgaatgtcgtactaatggcctccttcctctagcttggtgacagcctgtaaccagttacaaaaaaaaatcttgacatacaccttcaatttttatttaagagatatagtcctaattgttatgtcaaaaccttggaaatagaggccaattattttgaaaacgttattttttccaaatctacaaaggaattgccatatgatataatagctaaaggtgttttcaagatccattttccaattaattgctttaaaaaagaattctctgaagtaaatcacaagtgcctttaagattctggctggattgtttgttaatataccttagatgcagataaaaagcgggggcaggaaagagaaaattggaagcccactgggtcagaatggcaagttttttgcttttaccaaaaaaaaaaaaagacagtgggaatcacaacagaaagaggtcggatgctgttggtgatttttgtacctctgaagcttctaaatatagaggggtttattgcttctcttgataggttccttgtcaagttactgtagaaataacttacttaccccacctggaatttagaacagggcttttaaattttcaaggactgcactgcagttgaattgaagtgaaccagatgtaagataataggggttgggaagaccctgaggaagtaaagagtacacatctcatcaataaggggcagggcattgttggttacagtgcacccaagggagtgctcttagggtcaactagacaatcaaactgacttgatttccatgggttacacttgacatctcattcacttacagaccgagcacagtgtatgcccgcagagcagtactaggccttggtcttcaatgggaatccctggaacagtccgaatagcaatctagggacttttttaaaattttttttctctattcccaagtgttatttcaagagcaaagaagttaaacttgtgtagctaagtgtagagtctcctgatttagaaggtctatgtcttaaataggagccaagatctctggtgacgttcctataggcacagcttccaaaatccccaggtcaagcctcctcattatgagtcaccacactcagggaagcccaacccaataacttctcaacagatgtgttcatttgcagtccttccagccagattcagcttaccaatccggggtcattcttataacaacatagcctgcttatgtggctgacatttcaccttaccaggtttccagggtaacaaagccagaaagttaacccaagataaagttctccatagagagagagaattttaacccgttacccactgttgtcatatgggagtataaactcagatcttttcttttcctttgttcctgcttgcccttctcctcctctttctcctcctcctccaccttcttccttcttttagaaaagctggggccggcgcggtggctcacgcctgtcatcccagcactttgggaggccgaggcgggcggatcacgaggtcaggagatcgagaccatcctggctaacacggtgaaaccccgtctctactaaaaatacaaaaattagccgggcgcggtgatgggcgcctgtagtcccagctactcgggaggctgaggcgggagaatggcgggaacccgggaggcggagcttgcagtgagccaagatcacaccactgcactccagcctgggcgacagagcgacactccgtctccaaaaaataaaaaataaaaataaaaaaataaaagctggacgactagatttttaaaaaatgtttagtctcccaatttttaagcgagactactggagtaagaatactggaccagagaacagaagacctgggttctattaatagtagtctagcaatttgctgtgtgacctccctgtgttaagtgaaaggcttgcataaggtcacctgaaaagctatttctgtgatactgttaatcttttctaattgctaaagaggtgatgcttcctgtttctctgctcattgccagggtacttgtttctcttccatcagcttttctccttctctattctgcattatcatatgaaatcaaagagtgaggaaaaaagtcaaggatcttcaaaatcatacatgactgataccaatctcatcattggactagatttctcagtgaagataatctgagggttaatgctaactctcatagaatttaagtcaaaatatctgtctttgtttgcattgcccaaagaagttggatcaaaagagttacagctgggtggattttaacttttaacccagtttttcagatgtgttaatatatagtgcaaagtttccaatgtagttagagttactacaaccctaactgaaattgcctcatactgtgacattattatatcctacaatcactcatatatctttatttttccaactctaccatcacaactgagaaaaggtaatgtggtacatttacaaataaaagaggattaggattattttcattttaatattcccactataattatctacagatttatgaagaccgagtcaagggttccatttgtagccatcaataaagagattaatttattattcccaatcgggctccaaccctcaaactatatttggccattggcttcgggatttggttatttcctcaaccctttgtgaagaaatcttttaattttttgtgggtcagaggctctttgttatatggtagaagtatagtccgtaaggaatagaaaggacgaggttgaaagtagctgtgccttgaagttattaaaaatatgtttcactcatgataacatgatcattttcaggaattttattcttcctcccttgaccacaaatattaaacgtttcaccagggaaatggctggtaagagatttagtcctaggagtaggatctaatcttttatatcacagtaagaagctgatcaaaggtgttgaaagctgactgttaaaggattaattaggtcacattgaaatatatgattttaaaacagattgaaaccagaaataaataaataaatgaagctagctgcccccatttttttcaagaacatgttattgaagagaaaatattgagccttcatcaccatttaaaatattcttaatgagcattgttgaagccattttaaggagtgtgttcttcaacataagggcaacggaaagccatgagctcttcttctaggaattgagcttatatatcactctttctttaaagagtgcaggtaatgggttgcagcagaacagggctgtgtgaagagaaccttgaaacagatgctgcaataatccaagtaagagatattggtgtctttatcttgggcagtagctgtggtggtggattctttgtgtttcccactcaacccaaacacaaaatcttccagggctccaatctaagatcaaccccatcctcttggtcactggattgcattccctctcacccactcaagaacttcactctagctatcgttttactcctctctcctgcattagatacattttctttccctgctacatcactcctacctgcatcggaacaatgtggcaacatctcctgctttaaactagtaagaaactcccactgctcaatttctatgctcctcttacggcaaaactgcaccaaagagtcatctctacatcttctctttcacggactcttaccctcagtccattgggacttttccccagaattgcacaaaagtagctctcttcagtgatgtccacaatactaaagctgatgataaattcttagttctcacagtatttgacctatcagcagcattcaatacagctgctctctctaaacttctcaaatacttgcttcttgtggcttttgggctataactctcttggtaccccctttaaatccctggatttccattttctttttttttccatttttttcttttctggcttctcatttccctgtcatctactcatattcttaaagtaaagtataagtgtcctcaggctcaagacccaggcctttatctctctgtatacttgctctctagtgatttcatccagtccaatggcttcaaatgccatctttatactgatattttataaatacctactgtcagcccctctccctcctaaatacttgacttacatatccatttcctgctcatcttctcacgtggttgtccagtaggcatctcaaaggtaatatgactaaacctgagcatttgatcttcttcctaaatcttattctcctatagttttcccagtcacaggaaagggcacttccattcatccagtggctcaagactgaaatttgggtgatagtctttatttatttatttatttccatgccaccattcaatctgtttgcaaatcctgaccactgtgccttcaaaacataccctgtatcaaaccaactctccctaccttcaaccattgcaaccccagtccaaactcccatcgtaagtggcttgatcacaagagcttcctaactggtgtccctccttctattcctgtttctccagccttttgttacataaaagccagggtgatagatagagtttgaattatttgtccctgcccaaatctcatgtttaattgtaaccccccaatgttggaggtggggcctggtgggaggtgattggatcatgggagtggatccttcacggctcagtgccgtcctcacaacagtgagttctcgtgaaatctgattgtttaaaagtatgtggcacctaccccccatctcttgctcctgcttttcaccatgtgaagtgcccgctcctgcttcaccttccaccttagtaaaagcttcctgaggcctccccagaagcggataccagcactgtgtttcctgtacagtttgcagaaccatgagccaattaagctaattttcttataaattactcagtctcaggtatttcttcatagcaatacaggaaaggcctaatacagtgactcttttaagtgtaagtcgttcacatttctccctggccaaaagccctccaaaggctttacttctcactcagaaaaaaatccaaacctctcaccttggccagaagcccccataaactggcccctggccatctgtccgtcattatgtccccacaacccccatccttctgttccatatactgtttctcaaagacatgaaacacgtccctcctagcaatggggcctttgtgagtgttgctcccatgccttgaatgtgagtcccccagatacctcgtggcttgcaaccttctttcatttcaaatctctgctcatttccaccccttcccgatatttttcaaatagtactcaccatccttctccatcgctttcactgctttgttcttaatcgcatgtagtactgtgtgacataatactcctttttgagaattatatttattgcagatttgcagaatttcacggttgtactttaaagcattttatgttaaggtcaccatagatatattgtgcagtagaactcagaagtagaatgaatatgtaatataagtctcaaggcttgcagtaggctgctttggggtttgccttctgacccttcagaagtgtgtgttcactcagctgttccggtaaggacgcctcgatggaaaagtttaaaatgtactggttcatatggactgggcaattacccatattatgtaattgagggacacctacagaaacgatctctttccccttatctatctgtattggtctgccatcatacctgcaaaattccaccattactctctcttaatggaatcaactacaattagaagtcaaccaacaatgcctgtataggaagcatatgtagagacttttagttaaaattatatggtctaatcagcaagagtctatttaagggacaataaagcagaatatggcttattttaaagcattatagaggctctctcaacccaccaccctttaactgactttctggataaacagtctcttcattccttccgtaatgcataatgactgttgcctgtggcaagctgaaggttcatggctggtaggctacgctcaggtgaatttggagcactctgttcctaggtgttgagttggacactgccaaggatgagttgtttttattcccaaaccagtttatgccagtttcacttacaattataaactttaaatattatataaactaatgaaataaaaattcaaaaggcaagagttgtcatttccgcaaaaactaggtgcaatcctttggaaaagactcaagaaaaacaagccaataaaaaaattaaaggttctacggacaattatacaagtttatttttaaataaaagacaattataattcatactctagtataattctgtactcagatcttgtcacaactcttttgtaaggaaaccaaaactgtaaatgagagttgtcaatgcatgatgaacgtagcttatgtgaaaataacaaccctagtccactgtcaactttaaaaataaataaaaggtaagagttacattgttcttacatgaaaatattgacaaataataaatttaattgcctaaaaataaattactttattagtaaataaagataagttatatataaatatataaactatatgttatgataaatttcataaaatgtttatgacatacatatggcattactttatggtttcccacttctagcaacttttaaaattaccaactaattctaggtcccaaaagtgtaggacaagcgggtttttcacatggtttgaaaacagttttcaagagtagagattgcagtttcattacagacatgttgagaacagcaaaggaggtaaaatactcagatcaatcctggaagtaaagtaaaatcagcatgcccattctacatatgaggctaacagagagtcagtgacgtggagttgagctgttttcagagaactaagatttgccttcttcaaggttcatgctgttagctttgatgctacaataccttttcaaacctcttctcctatacatctcatttagatctttcataacttggctttttcaaaatagatgtcaactaaaggcagctgagctaatcaggtattttaattaatggcatctgaattattatgacagtgtgatcatagagatgccatttttgtcttcagtaatcaacccttcttccttaagaaggtgtgggagcaggtccttgattaaatagatctgggaaatgctgaatattggattctcctcttggagattttacaatgctaataagatttggagaaatcctgtagtaaagaaatctgcccagcattttcaacccagttgatatgatttggctgtattcccagccaaatctcatcttgaattgtagttcccataatccccacatgttgtgggagaaacctggtaggaggtaattaaatcataggggcagttactctcatgctgttctcatgatagtgagtgaattctcatgagatctgatggttttataaggggctttccccttccttcgctttcattgtccttcctgccaccatgtgaagaaggacatgtttacttcccctaccaccatgattgtaagtttcctgaggcatccccagccatgcaggatggtgagtcaattaaacctctttcctttataaattacccagtctcaggtatgtctttattagcagcatgagaagagattaaaacactggttatttcccaaacatatttgtccacatgattttatcatgtatgcctctttatgttggactaaaccagtattcagtggcacacatttaaaaatattgctattctcaagtaaatttggactcctctgttcatagctgttgagttgtacactgccaagaataactgatttttattcccaaaccagtttatgccagttttacttagagattattactagggaggccgaggcaggccgatcacctgaggttgggagttcgagaccaccctgaccaacatggggaaaccccatctctactaaaaatacaaaattagctgggtgtggtggtgcatgcctataatcccagctactcaggaaggctgaggcaggagaatcgcttgaactcaagaggtggaggctgcagccgagatcgcaccactgtactccagcctggggaacaagagtgaaactcggtctcaaataaataaataaataaataagtattatataaatgaatgcctttcatatgtccattcctgttcttatatattctcagcttgttgaccacagttccctgggctgaattttgtgagtgcacccttactttgttcagctttttgtcattatcaggagagaaaaggcaaatgttgcaaaaaaaaaaaagatagacttggcagttttttctaatagctaaactgtgaccttggcacccatccccttagaggtcagtaagaggcccttgtaatcatccacaagcagagagtcagctaaagactgagatcaccccttgctcatcagatcctggttaagaagctcatgaagaggaaaaaaaagttcagactccttccacaagctaaataagtgcctctagggtcaggcatcatcaaagagggtcaactaatcaatgttcaccaagcaatttgtgatctgaagtgttgcaagaatgctaaaattatatgtatcttgtcctttacaactgaagatggcacatcaggaggtgatagctctgtgttttgatgctggctgtgactttgtgccagaccttagccccggccctgctgcaggcacacgtccttctttacaggataaccaggcaatttgtggtttactgcctgctgtgtgtgtcctgtgcaaactcacagtgtgctgacacatgactgcctagtaaatatcaggggaatattgaatgctcgtgctcagagcttttattgggaaacactttccctcatcccaccctttgctcctctcctgaatgtccaccaccatgcatcagaacagatcatttatagagatactcttagggaatgccagtctgtgccagtctgcctgtcttccctgcccacatgctcttaccggggccgacttgacacccaaaacaactcagagagttgaagtgatttgcccaagaccacacagctaacaactggcaaatgtggtattgtatctaaaatactagcacagggttgggcacagtggctgacacctgtaatcccaacacttcgggaggctgaggcaggaggactgcctgaacccaggagcctggtcaacatagcaagacctcgtctctactaagaataaaaaaaatattagctgggcatagtggcatacacctgtagtccccagctactcaggagggtcacttgagcccaggaatttgaggtttcaatgagctatgatcatgccactgcagtccagcctgggcaacagagtgagaccctgtctcaaaaaaaaaataaaatgttagcataggcttttaaatcatgtgtttttcacttacagtgaggctgagtagaaatctggggaagaattaaagcagagattccagggatatgttagggcagagcaggactcatggaaggacaagggggttggttttgttttcaatagaattgagaaggtagagtttgaaaacacatttccagaagtccccgtgttggttcccactggatgcttgttaagattatgtaatactcttcagtgctatgtctgttgtttaagtgttctgttcattgggattcttttggttgcaagtgccaaaatccaattcaaatgagcttaaataaacacgggaattttttggcataaaagtcctattaactacaactagattttagttcccaaatgatagtgttaggatctctctatcatctcttgaatttgcttttcacaagctgcctctcactgcaaggtaactcagcgggaaggagaaaatgcttcatttccagtaattttagcaaaagcttcaaaattggcctttatatgctaacttgagtcatatgcccactcttaaaccaattatggtgagtggaggatatgagggtggtgctggatagaaaatgctgattgggcagccagacgacataggtctattcctggagccagaacggagattagcctcactcgtatagcatctactaagagtcggggagaaatgattcctgattttaaaaaagattagaatgaggttaccaagtcaggagaagctaggcacccaaaacaaatgatgtctacttgtcatcttattgtaaagtagggttgcaccccaggatcccatcccgaagagttatttctagatgtgagaggtgtataccatgtacaacaagatccactgtcctggaaacatgagcaggattcaagaaacttgattctcctaaaactgtatctctgctgaatatatcccactatgtccctagtgccaagaagaatgcctgaacctaataggcccacatgaagcatttgttgaatgagtaatttaaaaccaggcagaagggatacagagtttcagtttgggattatgaaaaagttctagacatgaataatggtgatagttgcacaacattgggaatggatgtagtggcactgaactgtgcacttacaaatgattaaaatggtaaacttttatatgtattttgccacactaattttttttaaagaagaaggggaaaaccttaggcattaaggaaaacaagattttggtgacttctggatttttgctttccatttaagcttgccttagtgagtcattggacctcaacggctaggcagtcactgatgggagcagaaagaagtacttatccagcacttctccactgaagttgagcccaaacattggctgttccctactttacagaagaagatcaagggatacaataaggttgggattgatggacgtcaggaggatttgctttaggaatgcacgtgatatatgaaaagggttcagccagaattcacaaactctgttgtctcctatggccagccaggcaggtaagaatgtaaatgaatcagataatgtgagtcaggtggagatccacagccttcctttaaacaggccagtcactgctcatctcagaccagttattgccttgaagaaatacaggttcagtagtgcctggtctcatggtttttcatgagaagccgtatgtgtggaatcttatatgaaatgtttccattttggaaaatgttagcaatcacttttttttcttttttttttctgagacggagtcttgctctgtggcccagactggagtgcagtggtgcaatctcagctcactgcaagctccacctcccgagttcaagtgattctcctgcctcagcctcccgaatagctgggattacaggcacgccccaccacacccagctaatctttgtatttttagtagagaccaggtttcaccatgttggccaggctggtctcaaactcctgacctcatcatccacccacctgagtctcccaaagtgcagggattacaggcgtgagcctccgcgcctggccagcaatcactttttaaatgttctacagtagcatggtaaacagaacacagctattttccagatctttccacttacttccagtttctttccaaggatagactcttcactttttaagaaatgacagtaatgatctcatgtatttgtttatttatttttacgtttttcagtttaaggtgacacaaatggttaggacagataccatcaccccaattttactcttgaagccactgagactttacatggagggacttcagcttgcacccagatcatgcgaaaccatgttctgtgccatgtgagactttaagaggttgctttcaaaactcccccgcaggtttccttatttatcatttatctagatgaattcttcctcccttacattggagaaaacagagtttctcaatttcccatgactctctttgttagtcagatgggagagaaaagtcattacctatgcgaacctgtagaaatagatttgtgtatttttcagtaataaataaaataaccagggaatttaaatcatataatattttccatcttgccagagatggatttttttttcccctggggaaacttttaacttaagaatgtgtttcaatctccttgatgtgttggaataatcattaatgtttacagttgctgtagcaactagaaatgctggcaattgagtaggaagggagcctgagagaggaagataagctgtatcaattattgaacatctgtcaaacagttagccaatttaaagtgacagacaaaaagctagaaatcgaaggtgggtacaatgtatttgttaagttaacaacatcagttatgtattgttttgccactattacagagggataattaacacttatttgcatccacataaagggagcattttctatggcgaatatacagttgcaagtgtaaatttttatgtcataatcatcttaatccatctctcgtggatgttagtttgcagtttcaatatctatttgacagacttttgcattttttaagagcacagaagtgaaacactatgcctctgatcatatgcctctccaggcactctcctctccttatcctaaaaccactactcatttatgcagaagcagtggcctaaatattggccacacgtgtctccagtactctgtcttactctgatggcagttatcatagatcaattaaaactcctttttcctctgagtctctggcattctcaaaaccctaacacagcacctggatagccaatgccagttaggaaggactctgtagtggagtctatttgcaatccctgtctgttaatgatttctcaccttcgcttggcgttttattgtttacaaagtgttcttacttgcatagtctcatttggtcatcaaacctctaaggtgggggttgttatcccttctttacatgtgagaaaactgaggcttagaaagattaagtgatttggccaagatcacagagttagacagaagatacctacttacctactgccttttccactgcactgtaaaagaaaagatcatcaggtaaaaatccagggtgatgggtttcagtactgccctaatcacttactaactaaaaagaagaagaaaaaataataaaacaagaaagtatttaatccttctttagatagttctctctgcttctaataaaggagaactgaacagattttttcctaggatgctttcagctataatctgtaatacatgaactctaagtaaaatctagttgctaagtttctcaattacagcatttgtttattaccaggccacaccctacctcgtggctgcactcccagtttcttcccagatctcagttttttgaaagtgagagagcatattaattttataatttttgctacttctatttgttagcataataagcatgctaacactgtatacatgatcacaagatttaattttctggcctggctttgtttaatgttaagttttaatgagtcaccttttctctcttcctcattttcttttctggaaagcaggattattagctccaagagatgagtcaaatgaagtaacataaatggaaataactttaggaaaataaaatactgtctatgataagatattagggtagctttattccttataaattctgacctgatctgataatattaagtagatgatgatttagaatgggtcttcagaataaatttaaaggaacatgtaagtcatcaaatgattctattcaccatctttgccttatcaacaataataataataaacattaacatttattgagtgctaccatgtgctcgacactgtgctgattataagtagcaatttggctacagtattgcacgtgatcccccaaccctcctatggtgtgttattattatctccatttttcagatgagaaaattgagtcttagatatgttaagtaactttccatgctcacaaagtagtggtaaaccaaggtttcaagaccatgtacgtctaaccccaagttctagagtagatacttgaccggttataaataatacttcacacacccaaggtaaagatatttattttaaaatagaacaaagcatggtcttgcctagatgtcccataaagagctgtaatcatcagatgcccacttttttcctttaatttttcttgaagctgacttttttcttgcaagtctttgtgttattgtcttcaaagaattacaagagtcattgggaagaatccaccatttctaagaaccagtttttacgcagaactattttaagtggtaccagatggataggaaattagtatacaactatttttcaagtggggcttaggaacaatggtaagaaggggccattagtaaatggaggaaggtaaaataagtctctaaggagaaaaagaaatgacaagggtttatattatattaagaaatttttcagatactttttatcacaggggacggaaaaaaaaaaagaacagtgtccactagggagttttttataaaatgaatttattgtttttgttttgttttgttttgtttttgagacggagtctcactctgtcgcccaggctggagtgcagtggtgcgatctcggctcactgcaagctccgcctcccgggttcaagcgattctcctgcctcagcctcccaagtagctgaggctacaggtgcccacgaccacgcccagctcatttttgaatttttagtagagatggagtttcaccacattggccaggctggtcttgaactcctgaccttgtgatctgcccacctcagcctcccaaagtgctaggattgcagccatgagctactgtgtctggcctaatttattgattttttttcaaagcatattacctgaatagaatatttcttctgagtagattttcttgaggaattcaaccaccacatgtactcacttctctgcctgtcagttctgagtcctagtttcttctcccagaccagcttgtcaaaaatacattagacatgagcatggacactttgcgctcgctctctgttttggcgtcttgaaaccagaggaaaaaagacctgtttgttcagtttgaattttaaaaatctctgattggctgatttaagtcatgtgatcctcactgaaccaatcactgtgtcctgaggtatgattggtctcctgtgactcactcccatctctatgctggccttgggggaatgatgactgccgttccccaaaaaccaattgacgaagcattgctaagaagatgaaaagtgcctttctggcaaacctggtaataaagccaaactcatagatgattaatctttcatctagtcctcttcactgcacctcaaggcagaaccggaccattgcagccagtgatggtcttttttgtttttaaaggtccaaataaaagaacaaaatacctttattttgaaaaggatagttccattctttacagaccaacagaccgaatgcttttgttattggtttcacaggagcattagcaagacgcagggaagcggggaaaagcatcttgggccataatgaaaactggcattttatttttctttcttcttctttttttttttttttttttttgagacagagttttgctcttgttgcccaggctggagtgcagtggcacaatctcggctcattgcaaacttcacctccccggttcaagagattttcctgcctcagcctcccaattagttgggattacaggcgcctgccaccacgcctggctaatttttgtatttttggtagagacggggtttctccatgttggccgggctggtctcgatctcctgacctcaagtgatccgcctgcctctgcctcccaaagtgctggcattacaagcatgagccaccctgcccggctgaaaattggtattttcttagcacatttgattaagggttaatttgtgctcgtgatttaaatgtcagttgtctgaattttagatcacaagtttaatcaaggagaatgtggaattgtttaataatttggtgaaaaggttgtgtgttgttaacttgtgtgggagttgattatattacttgaaagcttgctcagtcagtcatattactgcttgaagccttaaagaaagtaaataattagagttaaactgacattttccaccattcaacatttttttcattattcctgagaatccattttagttcccatattgaatcctcttttttctttcttcacagaaattgcttagcttaaagtaagaagacagattttgattatgctgtgagaaaaagcaaaatttctattaattatgatttgtccagtcaaaattttcctacgaaatatatttaagtgctgatggtacgagtgacccgtacaatactgatatttcaggatttaactggtcacctagttccctgaaattctcagtactcctgaatgttgctatggggttaaatactgtggcatacaaaagaaaacaaggttgtcctgatccctaccacagtccccctcaaccacaggcctggcacatcagtcagggtaatcactgctggactgccatgtcattggcttagttaagctggaggtttcagttgcagtggctcctggcataggaaaagaaatctttgtcatggtctcaagagatgtctgttttaatcccaaatctaattccactgatagtctttgtggtcttggaatagcttatgtaattttctatatctcactttccctgtctctccaatggaactaatccttattctacttatttctaaaaattgtcagaggcaccaaatgagataatggatataaaagtgttttgaaaatgtaaagaagtaggaaagttgtggttctgctgatggagatggaggcttacttagtaaggtgaacaaaagtatctggctcactggatccagtttaactttccttgtgcatagagatgtcttattcagtccaggtgttcctgtcacctttgagtaactgtgatctgacctgtgtccaggtcacacgggtgtcatctggtaactctagttttcatcaacatatgtcatttagcgtaagtcacatcaggtggactaacttcgctgctgcatgctttcctttctgcctttactgagtccttctcattcttggccagtcagtcatattttctttctgtcttagtaaactcagcaaaactgcaccagagtcagaaataaatggaaagggaaggatttttaacgaaaggggctcactcattctgacttaaaacatgtattttgatagtccagaggttttttttgttgttattttttccctcctctgatttcagtgaatttgatttaccattaatggtctgatgaaagagatatactttcttatttacaagcgacttctttctcaactaacactttgggcctggagttcagcaataatactgttgctccaggaaacttctggcatttggaattccacttcgattcaactaatgcttagtaagttgatttcacaaaagtaaagtgtatgttctctggccatatgtattcttgtccacaagcagtcttcaagcctggaagatggaggagagatgagcaactgaactattctaatacagttacaaacaaatttcaacgtgtgaaataatgggctggttgctacgaggcaaaaaagaaacaaacacttattttgttgttgaggagagaccacatgtaattttcctggtcaggaaatggctttttgcaaaaggtggtggctgagataagtaaagcagggaaacacgtcctgagaagagagtgcacaagccttgtcagagggactgaaaagcacccggcacacaaggggatcagtgactatttttccactataccttaagcaacccttcttagcagtataaacctttcttaaaatacaatttcgtggggaagtgcaaatttcaaaaacagagctctctgcttaaagcccagatggacgggcacagccctcccactgtgtcttctctttgcagctacaagcgacccctgcaggaatactatgtattgtatgaatccattaatcacggatgcccttactcagcctccctaaagttttgcaactcctcgcttgagggatcctccccaagagtatacattaacaaagagtaaagagtagaaagctaaaattaagtaacttggggtcctgttatggaaggatttgaatgtgagctggatgcattttactttatccaggaggcagtgggactcacagaggatttgtgtgggaaggaaggacatgactcaaagctgccctttggtaggattaatctgacagcgttgtatgggttggcctgcagtggcactgaacctgacacaggcaaaagagcaggatgttcttaggccagtgacagatgacggtgagacaaaaaacctctatggaattcgaatccacaggacttggatgctgattttctccccagcaatgggacccacactccttcctagagagaacctgggatcaaaccacagggcttgtatgaagcgggcataagtgtggagctgaaagagttgtatcatgtgattttgttctgttctcctgctacttgagaaaaagccatattctttctgagactgggcattgaactttgatagttgtctctttagcttttatgtgctttccacattatctgaaagtattctatacttggctgtcaaagggtatccatgcttcaagggattaacacttttaaaatgagctttgtgtgtttgagctctttgtaaaatatggtgatacctttgatttcttaaaataccaaatttttaacaaatagctgaaagaaacattctttatcccccatgaacagtgtttccatctgcccatcatagtccacttcagctgcatctctctgccatggctttactggtttgatggtttgatcacactgaacagactgggccatctattttttgttttgtttttttgagacatagtcttgctctgttggccaggctggagtaaagtggtgcgattatggttcactgccgccttgacctcctgggcgcaagcgatcctcccacctcagcctctccagactcctgagtagctgcgactacaggtgtgaaccaccatacccagctaattttttatttttgtagagatgtggtcttattatgttgcccatgctagtctgggccattctttgtcacagtcaggcaagggtctaatgtcagttctgtatgatttcagcaccccacttttatcccatcaaaatactcatattagcttatatttgttttcttcagcaccattcttataccaacaaaagtatgcaactaagggtcagttccatttatttatctttgtgtctgtatcctaaagcaggggctacaacctaaattgcctatagattcatataggactggtatatggagtagggaatggtagaggctatggcaaactggagactgagtgcctgttcctcagtggaaagctgctattcacctttgacaatcatttgcctgatggaatgagagcctaatgtatccaaaccttttaaaacagtgtttctcagagtgtggtcttcaggccgacagcatcagcagcacctagaaacttgcaattcttgtccctccctgttccacctccagaataagaaattccaagagtgagatccagccttttgtgttgtaacaagcctttccagtgattgtgatgcttactcaaatttgagaaccacttgttatagtggacattgtgttgtatcactcagactgcttttgaggactgatatttgaggactatgtttgtttcaagaaaagcccaatatcaaggccaggcacagtggctcacacctgtaatcccagtactttgggaggctgtgatgggcagatcacttgaggtcagtagttcacggcaagcttggccaaaatggtgaaaccctgtctttaccaaaaaatacaaaaattagccaggcacagtggtgcacgcctgtggtcccacttgggaggccgagatgggagaatcacttgaacccaggtggtggaggctgcaccccggcactccagcctgagtgacagagtgagaccctgtctcagaaaaaaaaaaagaaaaagaaaaagaaaaacccaatatcaagatatatatttgatttttagttttttattatttatttttaattgacaaataaacattgcatatatttatggcatacaacattttaaaattcgtatacattatggattggctaaatcatgctcattaacatgttcattacctcacataccattttttctatggcaagaactttgaaaatttactctcagcaattttcaagaatagaatacattattagtaactatactcaccatgttgtacaatagctctcttgaacttattccttctgtctgactgaaattatttattctttgaccaacattcctccaacctccctgctccccagctagcttctggtaatcacaattctactctctgtttctatgtgttcaacgttttgtgattccacatgtgagtgagatcatgcactgcttgtctttctgtgcctggcttatttcactttgcataatgtcctccaggttcatccatgttgttgcaaataacagtattttattatttttatggctagatactattccactgtgtatatatatcacattttcttcattcattcatccactgatggacacttagttgattccatatcttggctattgtgactagtgctacaataaacatgagagtgcagatacgtctcttcaacatttcattgcctttggattttcagtttcataatatagggaaactataacagacacatccacttgtcagtctcagtctgtcctgtgcactgtcactcttcagcctccactccagtctgaacatgctaacaaaaaggatgctttcctggtttttttttttttttaatgacttcttcccttgcaggatgcaaagtttactgactccagatctaggcaatatttctcaaactttctcactgatacagttctgagagcagaggagagacagggaatgcagaattatatgctgaagccattcactgccaaatacaagattttgttgaagcctttccatttgcctttaaaaatcatataagttgtatgtcctattttgtcatatactcatatttggcttattgtctaaacaatgagttaaattactttcaagttaaattccgtaacttccacccacaatttcttaaagaaaatctgcaccctagaaaaatgctcaatttacccccaaaaaatagaggcaagaaaataagaagttacatgtaagagggggaagttataagtcatactcaaacatattcaagagccatatacctgaccagaaaatgcaccttttgccatcttgcttttccatacctccactgccacatctgagcgagtaaatagcatgtactaaaaatatcttgaacaaagcgagtagtctcttagttggaaggcttatttttagaaatacctggcacaaggttggatgagatttagtactaggccttatctaatccttgcctcatatgggcaccatttcatttctccaaaatcagtactgcaaagacggtgaaaagctttcactttatgtgccaacacaaattgattggaggtaattgcctgaaacactgtactgagaatgattctcagtctgtgtctggcagagtcaattataaatgttagccatgggtgtaggagtggcgactggtggtccaagtgacagatatctgtcatccctgctctactcagcactaataaaaaatgaaagcagtgtctgaaccctggatggtcctgctcattgcttgggacctgtctaaaccaagttctctggaccacagaatattcctaataggggtcctgacagctacagtcatgatttcagcaacctaagctgcaaagggtcattaccgtcattataggtttaaatacaaattagtctgtcttctaattaatagaggtacaatatctctcccatttccacaccttcagatctcaactcatctaagacactgcccctccactcttgtttcccaagcattgttcactggatgacagctcacatatgactttatatttatcattctgtgtcttagtataattaaaatgtcatccagaggccccctctctcagaatccaaagtctattggtcattctcttcttgagagagctctttcatatgacatgagtggttttggtttcttctgaaaccaaacactcttgccttctcctgctacctgtttattgtgcacaatcatcagtgctatttaattcttgcagttcctggtataattcttactttctcagggaaatttttgggttgctcgcaatttctaacatttttttttcgcaaaggtcagagaaagacaaggtatcaatccatttacgaaaagataatttttgttgaaaaaaatgccaaaagaaactctaagaatttacattaatatgtttggtgatcggtgtaactcttggtttaggcagggaaggtattcttttaattatcctatttttcagatgagaaaactgaggaatagaaattactttcctgctgattaaatcccgaagccaagactcaattcatgtctcttgacaccaattccagagatctttccatggacttatgccatttttccctttgctcagcacactgataactaattccaacccctgtctttgtaactgctctccagcacacctctccatctcagcactgagctcagtgcttttgcaaacaactgatgctttgtaaatatttgaccaacaaaggaaccaatgaatacattcattttacccatttcatttgtagaaatcacttaaaatacacttttcacatctactttcttagaattatatatccatttaaattcaacctcacaaacactgtgtaaaaaacaggatacatattgataaaactatctaaaggtaaggggactctatcatgctgttaaaatcatttattaaagccaaaatttgttataatgcaaagactaccattcatgtctcctgacttaactctaatatcttccttctacaaaacacaacgcagcttaaatcaaataaataagagtgtgtgtgtgtgcacgtgtgtgttccagttcttgaccttgccagtaactacccttgtgattcctagcaagttactgggtttccttggatctttctttccttatttgtcaaatgagcatgttggatttgatgatctacatatagaatgtacggaatgatgaaagagactgagacatcatgtaatcccactcccccaatttatagataaggaaaactgatttcttctggctccaaaatacatttttaaaggaacatatggcttcctaacagaatcagctcttctgaatactggggctaccccacagtcccatccctgccacttgtcaaatgtgtgatcatgatccactcatacagtttctctagacttcagtttcctgatatgtaaaattgaaaaagttggactaagagccctttcaggtttaaaactttgaggttaagaaaggcatctttgaaaactgacatctttgccactactgggatatgactcagaacataacgaagcataatatagctctagaaataaattggtgtcaagaacaattaaagagcaaccatccagagaattctgattgatcatttgtgtaatctgttcaatgagtacctggatttgaaaattgcttgattggtgtcttcttttaaaaataagagccatacatcatttgttgttggcttagagatacagaaaaaagaaccaattaagtgagcttcagagttaatttccaatagatttggatgctgcaaaccaaaaaaaccattgctaggcctttcttctttaatgagtatcacaatacaactagcctcagtatttttcagttgagccccagaagtttcacaatccatttaatatgttgcattccaagtatctgtttactcagttgttaaaaattgccaatgggacagaaactgtctgtcacttccagagcaattagtgtgtgaaaacttatcaaaagaaatctgtcaagtttgagtaagtataaatattgcatgaaagtccctaaggaaatcaaactgagtaggatacacttttgcgagttgcagcacagaaaagtttattttgttttatttacttggctttatttttcagaatgttgatagtgcttcatgtaacccaatggattaatgttttgctctgataaaaacagattttggttcttaagggaaatctcaattgtatattgagcgatataaaaataccagatcttggtttcaaatatgaagagctcttactttgtcctagatgggacactggaatgagagttaagctagaacgagtaggttatagtccgcctcacccctttttggtgctccagcctaaccctttctagacctcagaattttcttatctttaaaatgaagaaataggacaagcgatttgttgggtatgttttagttgtactacactttttgcctgctttgatgtctacattctcattacattatattcctcctgctccttcctgattgccctgaagagataaacaaataaaaatacaatattccaggtggtgatatttgatcgtgaaaaaaactaagttaatatcttggtgagagatttcccctgttttaggagcttagtgcttaggccaacatgttctcaccagtacaccagccaagacttttctgctgaccttcccacttcaggactccacagtatttacaaatgtcagatgttgaaccatgttggttaggttccttagcatcttctgtttgaggctcttcttggcatctatggtttcttcttttttttttttttttttttcagcataagaaatggttacgctgttatattgttattacaattggggaaacattacaactttaattcaatatttgttgttgttttctgttgttctatttaatattaatgattttgtagaaactgaagtaatacagttaataatccgtatattttacttattgttttttgaattgaactaattggtacagcgtttcccaaactaggttttttgagctgtgggggttagatggttgtggtggtggtaattccatgagcaaataagtttggatgcttaaacactctctaaggagtttcaaggacattggcatgacaaaatctcttgccagtcctgaaagaaaaaagttgaaactccgttttactttgtttaatccagtacttctcaaagtaatttgatcatgtaaccctttgagttttagggaggtgggggtagaaaacaaagaattaatcatcaaagaccactgtttaggaaatgctgcaggaggcacttccggttgtttgcatctctcactaagttactttagtcacaaaagcagtgaaaccaaaggaatcaacctatttttaattagatcaaatagcatgttaattgaattttcaaaaaagtttttacttctataatgattaacctgttgaagtgcaacaccaataataactaacatctgtacagccctttagagaattcaaagtgctttcacataatcggttgctcaccacttacctgcatcacatttaaaattgtcctcattttatggaccaagaagctgaacatgaagtttaaatggcttccctaatataacgcagatttgaactttagtcttactttgttgttgttgttgttcctctccaattagaaaaagaatgaagcagatgccattttcccaatatcgactttctggttgctaaatgagcctcccgcagaattcagagagccttgcagccagtagctactactgagagttctgaaaaatattgcagggaaaaaaaaatcatttcctagccaggcgcggtggctcacacctgtaatcccagcactttgtggggccgaggagggcagatcacctgaggtcaggagttcgagaccagcctggccaacatggtgaaaccctgtctctactaaaaatacaaaaattagccaagcgtcgtggtgggcacctgtagtcccagctacttgggaggctgagacaggagaattgcttgaacccaggaggcagaggttgcagtgagccaagatcgtgccactgcactccagcctgggcaacaaaaagcaaaactccatctcaaaaaaaaaaaaaaagtttccggtatttgattccaactctccttggagaaatgtgagttgattagtattgtgctggtaaattacattctaacttccatcatgtgactttggaggtgctaatttatacttaaaactctcttataaataattaggggataggtaatcttctcattttgcataggagaaagcttaggtgctgatagattactaggtttgcttgaaactcacctgttgagtatgtaaggactgcattgcgatgctgtttgttgaaagcctgccatacgggatagtacttcttcacaatgtattataggggcttttcctcccccagattttagtttcttgaggaagctttctggaaagcacttgtatatttacactgagtatcctcttgacaccagcatggggttacttgtaatgacatgcacatgcgtaaataaaatgattagccattctcatataaacataattatatctttctaaaataatacatgtggaaatgttataatccagtgataaagggaaagcaatgtgcatgacccctcctttgtgcgtaaacagtggatttaaggcagaatatgtttcctgttgcacattcagttgttaaggtcaagtacaattgggacacattgaaggattacagtacaaaaaatgccttttacagtaattagcgttctctctacaaaactgaagtgacctttctgctattttccaaggacactttatacatttagactttagctcaggatcatatgaaaaagtgacatataagaactcagtcaactagttctgaaaccagaggccccattgcatttagttgttcccttaccctcccctcaacaaagtaatttttgaagataaagtgggacatgttggctactcagtgccagtagctagtatatcacttctccagctttggacaaatctggaaattacactttaaagagaggaatcgtggaatgcctggagctgaagcagtttgatttccttggagcacaatagttcactgcagcaaatcatttatactcactgtcatttagtggtcttctctgaaatggaaagcatgggctcatgtggtccttcataaaacatttacctaattcttataaaagttagaactttcaaaggaacatttttgatacaactgcctatgaaattcatcccactggtcttatgggataagggtgtgtgaaaatgttgctgttttatcactatctcatatccactccctcgtggatctaattttttttaatatggatgtatatttgtggaatcagtcaactagtcagtcagtgtatacttaatgagtgtttgccacagtgttaaactgctctcttactaaaatgatggaaaagtattcaacctcacaagtgagaagaaaaaatttgagttgatagtaggaggcattgggagaagactgcattgacactcaggaattattctgtttctaactagagctaagaatttgaataagttactctgttcctaggtgcccgtttctcagttaatggaaataaaactatcaaatatattggaaagcataaagtgctatgcaagtatggggcattatgatgtaatataatgattattatctataaaacaaaagaaatgatctaaatagtttccagggtggcttccagcattactatatcaagattataggcaccctgggtctgtaatttgagcattactcaatacatgttacatagtgcctgacacctgattagcaaactataaatgcttagcccttgacttaaagaggttggacatcgcttaatcagctatcagtgtatcttttacttctctggaaataaaaccttattgactgatagtagaaaggctggtaaaatgccacgggggactgtgattacttcctatctgtatttagtgggctgaaaaagagtcattggacaacaatgtatacatttttaacctgatcatttctttcatgaaaacagtagagttccagtgccaaaagacatatttgtaatgaagatttttttcctttcagagctgagttatgcctggatcttcaatgaatacccttcctatcaggataatcgccgctttgtttctcaagagactgggaatctgtatattgccaaagtagaaaaatcagatgttgggaattatacctgtgtggttaccaataccgtgacaaaccacaaggtcctggggccacctacaccactaatattgagaaatgatggtgagttttcaagtaattttgttaattttgtttctgcaatcacaggatgaatgtggaggtatgttatgttgttggcacatgaagctttgttgtctaaattaaatgtaagaaaagtttactgcagcctatatttggtacccatattttctccacttgtgtaagagataaacccatgaatccattttggaaaactaattagaaatctaattgctaatctcaacaggaatagaatgaggatttaggtgaatataaataacaaaggaaggtatttcttgtttctctcccacttaaactgtatacacagtcagaatgaagtgaaaggttgaacaattagctcattaatcaattctgtgtaatttagtattctgtgtccaattatccaaataacttctggatgtacagtactgaacgcatagttcccaccacagtgaaatgtagacataacaaggcttgtttgagacagaaattttaattccccacactattagaatatttcaagaaaatatatgaaattcatatattcttaattacctaaatgacttaacaatgtgtagtaaaaatcactgtgtactttgtaaagacggccgtgtatgccagactctaggagtaccatgccctttcccaccacgggtttttatatatgctgttccctcttcttgaaatgctcctcctttccttagtcccatcctctcagcttctcccttggataaactgatactggttcttccagtttctttaaagatgtcactgtttccaggaagccatctctgcttgctcaccctgccacccaaccatgctgcgtcaggtacctactgtatcgagtctacgaccataccccaaaagatctcataattctgcatcacagttgtctgtgttcttcactgtctgtcttactagcaatttgcctttttaaagcatatgtagtaccttattcacagccacctctgctgcacctggtttcgcaactggtacatcgaagattctcaataaatatttgttgaataaattcaaacaaagacataattaagcccttcaacaagggctgatatcatgatttaagcagtcgttgtagacatgttcaggtttctattctttttaaatccttttactgtctagtacacattcagatcttctattatgaacaggaatgacgagacccatcacacaagtgaggataccatcagccaaaaacattaataggaaacatctacttgacacttaatatgtgcctagtcactgtgcacagaactatatgtgaattatctcatttaaatctcaatcaattatatgataaacattttcttttgcagacggggaaactggggctcagccacatttgttaaaaattaatggctccaagatttccacccagcacccatgtcttactgactccagagcctgatatcttaaaccctcacagtgcttcgttgcattatactgtaacacctcttatctgaatttatacaagaaaaacttgacaaatgcaagacgggaactcagatttctattccccaagtttgttactctttccctgtgttttgtcagtgaactttgtgcccaagtgatgctctgaacctgaaccttccagaacaaagtattttatatactaagcagctctgaagagagggtctgagcatcctttctacatagactacactgtggaatttttgagcaaataatttagattttaaccattcatttattcatccatttaacatacatttatttagaacttcctgtgtgacagccactatgctgagtgctggtgaacaggaggctcttgcattctcctgggggatgcagacacaaagaaacaagcaaacataaacaaaaccaaaatcctattattttagatgccagtaaaccagtatgataaaatagcagctctgtggtgggtttggggggtggtgggtgtctactttagacagccatggaaagcctttctaaggaggggacatttgagctgagatctgaatagcaagaaaccggccctcttaagatcagagggcagagctttccaggctgagttaacatcatatgcaaaagccctgaggcctgaaaaaaagcactcagcatgttcagaaaacacgaagaacagttgagcgtggttgaagcatagtgagcaggtaggagggtggatagaattaaggttaaaagagagttttaatcttaattagaaataggagaaattagcagattttacttcgagtgcagcgagaagccgttagcgaattgtatgcaaaagagtgatttatgtttttaagaagattgcttagctgctatgtggaaaacggactttcagaaaacaatagtgaaaactggaaatccaatcagaatactactgcaattaattcagttgggaaatgatggggggtgaaactagggggtaacagcagagaaggagagaaatggattcaggatatagtttgctggtaaagctgcgagaacctgatcattccttaaatgtgggagacagtggaagagaaaatcaaggatgacacataggtttctggcatagcagctgagtgtatgggaatgccctttactgaaatggttttactgcacaggttagcaaaggaaaaatcaagaatactattttaaacattatttgtaaaaccaaatacataacttctcccttggcaacaggaggaattatttgttttgtgcttttttggccatctttctataataacattcatctggtatattcatatttgtccgcttgccttccccaccttgctcacattatgatcaaggaaagatcagcgttttcatccgactttgtactgcgctccagcacggtgcttgccacatggcaaatgttaaattaatatgttggattaagctacattatattcaataaaactgaaaattcttatcagcttaaagagaaaagtaagtaaggtactagctctgtcaaaagctatcagtgctatctctccagactgacagatgaagaaagtttcaaaagatatgctccagtggcattttgtaagaaatctcttaaaaatacagcccctgtggcttctacccaaatgcacttaggccagaatatctgttcagtggtattatctgttttggtctatcaagtcatggatgtaattacatattgactttgatatactgtgacatagccagggacagacgtcacacagaactgcctcttcaaaaaacaagaaacaaacattcaggaacacaagcactccagaatcatcatgtacacttcaaactggcaacaactctgccttttccctggcttttagatttatcttgatttgtctggtatatcttcatagagatgacaaatgttttgtattaaaatattttatcacaaagttagcagactaaagatctcattcttcagccattaatgcccactcattcttaatttccatgagtgttgcatggtgaaaattcatgtcttttccatttacactggagtatataaaatggacactcaaactgtgttactaagcacaaaataggttattaaattagctgttttctgaagatgagagaaaaggggaaatacaaatcaagaagagattgcaaaataaagaggacattcttgttaaaatctattctgtgacagtaaaatcaatgaaattctctctcctcaagatctgggatttggtgactgtatattagactggtaagtgcaaggtgagtatagaatttgtacaatcattttgatgattgaagcacactcaaaatttcacatcctctgtctgcctcagaaaagggaaaaaaagcaaggcaaaggagtttgaagcctgagctgaactaattgctagacttgtcatttactttgctaagagcacatgtagctggcagaactgtatttccccaatattcagcttgtttcttgggcatttcagctaagcagtctggactatgatttcttatttgtacccaaaaggccacagtgagtcataaaagttgaacagtgaaccttggctcagttcctaatacaaatgaggtgtgatgagtctcatgtctgttcactgaccatttaccactcacccgagtcctgcaaaaccctggggctccctgttcccttttccccagctcttcacatggctcactccttcctacatctcagatgatgtctcctatgtggggccaggaggtaaggacacaagccatgaggatcccgaagccaagcagtccaggcagagttcagccccaccatttattagccacgtggctttgaatgtgtcagtttaacctcattgtacttagttttctcatcagtaagataagggtaacaacatctacctcagatagttattttatgtgtcataattgaaagtactttgaacagtgacaaaacagaagtatatcatcaataactttcttacctaaaatatgctcaacaaattatatttttaaaagacagattactatagtgtatagatcatattattcttcttttttaaaatagtggataatgacagggaaaagtggaataatactctccaaagtgactaacgatgttaaactctaaagggtttaacttttagtggtaaattttgatttatttttttctttttgcttgtcattatttttctcacttttctaaaacatagagttttcaaatttttagaacattgtttgataaagattattggacctaataggcacttagagatcatgcaattttatatctttattttttgagaaacaagggaactgaagatcagagaattcggataagaaaaatggcatcaggacagattcctggtccctgatcatcatattatttcactgaggttcagaaaaggctgtttgggctctagatttagacatttgcttcgtttcttttgctttataatttttgataattttatagtgagaattatttcaaataactatattactttgcagtattcacttctgggacacataaaaatatgagttggtagatatatgtgagaacagattttatcagagtttatagttatttatccagatatttttaaatctgctttgagaagataactgatttgggaaagtacacctgttgcttaggaaccatgagagggagaaagtataattgggaagaatacatcatggttattattagtacaggtactaaagtagtccattgatccttattagcacagctgttggttataaatagtgatgagcctgctctgttatatgcttcctgcacagatctcaaagagttatccctaaatttccataaacaaaggtaacagaccactcatatagcataactactaaagaaatagtagccttcgatgataatcatattggctcttctgtctttagccacttacatggctctctctaaaatggcttaagatgaaaagaattagcagagattaggacagtcttgagaagatgagataatgtctgttacactgtttatgcacattacattacacacacagggaaatcatttagcatgaaaattcattgtttagcctttgcctttttttctgttttcctggagactggttggggactggtttggaaggtttggaaggttttttttttgttttgttttgttttttaaattttgcttattagaacaaagatgaatgttgagcaatttatagcctgtgtctgtctgataggtccatgcattgcacagtaattgttaaatatttttgaatattaacccgaattggaactccacatagaagagatgctacaaaacaaggaacaatgagattatcctatcttagagtttcaaattctctctttctctgtactctgtctctctttccctttctctcctccatttctatatttacatacattgttaatcatatacattttggatataggtatgtatatataaaccagatatattgtctttgggggttcaaatgtaaagttaacttctctaaatgtttattatacttcagtataaaattaaaatgtttaaaatgtttatgtatgttctcaaatataactgaaatacctgaccatgttttcccaagtcctcactcatttttcacagcctaatttagccatgaaaaacagtgaataagagcagcattgaagtatttaatcttctcatcttaaatcaagctttcacccagtaggaaaaagcccaaacgatgacctcagcatccttcagtttcacaacttttagtcatgtccaggactaaagtcaagagggcaagtaaagggattctggagtatagtcccagacgtaccagcagctctcataagacaaatcattaccatttctttggtccttagtcttctcagctatgcaaaatgggtgatttataataagttctatctaaagtttcttcttcttgtcttcaaggattccagtcacaactttctagcctacttaactccaatctcaacatttgcccaagccagataatatcaggtttaacagacagatgctgctcattgaatccgatttctcatcaatgctgacagctgatccctgcagaaaactaggtgcattcagtctttcaggccacagtgcgccattttgtgagccttcacctctgtgaccattatacctcctagtggctcagaagactacattccccacaaacttctaaatttaagaccaaaggagacctttaaaatagaaagcagaaaactaaaagattctgaaatattcttgttgcagcatcatgcatcctccattatggtcttgccaactggtcactgtaaactttcctaatactgctccatgctacattagatcctcaactgggcatcaacagccactatttttcttcatgaaaagggagctttatttgtaggccacttaattaacctagtgggtttttgaacccagtcatttaggagatctcttctagattggagacgtgatctacaaccctttattgaagacctggcatttagacaggcaacaggtagagatatgccttccacttagacataattttatattatttaagatctagagtttataccaaaacactgctttattttactctcacttctaattgcaacctttgtgtggttttgtcacagcaatcatgtcttgattttaattctctgacaacatcgcagttgaggatctgtgggcgtaaaacatgttttatgaggagaacatctaaatgactaaaggatgtgagatattttgctaaactgccattgctaatctgatttaatagcatcttaatggctctgtgtattttgaaggtttgacaagcttaggaacttggcagtcatctttagacctctagcatagccaattccatttcaggtccatgggggctaaaggtcttggatggccatttggctactcagttagaaagcatctgttaagtgctcgttgtgtgtggcacactatgaaataaaaagacatgatttcagcctgtgggaacctacagtcttagagaattccaagttaatgaagggtctaaagtttcattctttactggaattattgaattgagttctgaataatacatttatagagggacttgaaatgaaagagggaagcagaggtgtttagcctagaattgagttgacttggggcattcttttgatcatgcatttaaccaacgaatactcattgagtatctgttctctacttgtctctagagatgcaaaagtccttctctgccctcatggattatagcctggctgagaagcctaattgcagttagaagcaggagtggggccatactcaggggagaatagagaattaaagcagattcacttcagtttcaattttggtaagaactaccttggagcagtgaagtgtacagggaaattaggtgtagaatcacagcttaagggtgaagaaaccgggcctggtcttgggaatcaacccaaacttccatgaagagtcagacaatctaagataaaataaataattccaggcagcaggcagattatttgttttaactaggaattggcaaactctttcccacaggccaaccttgcctgtggcctgtttctgtaaataatttttctatagaaatgttgggtattcttggctaattcctagattctctatcatttttgctgttacagtaagttgtgcttatccgtttgtttttgtttgtttgttttttgagatagagtctgtctctgtcacccaggctggaatgcagtggtgcgatgtcagctcactgcaacctctgcctcccaggttcaagcaattctcttgccccagcctcccgagtagctgggattacaggcatgtaccaccatacccagctaatttttgtatttttagtagagacagggtctcaccatgttagccaggctggtctcgaacttctgacctcaagtgatcctccaatctcggcctcccaaactgctgggattacagatgtgagctaccatgcccggacagttgtatcttatctttaatcacattatctaattagttgttgcttatatatggaaggtactgttattcttgtgattcagtatttggcaagcttgctgaaatttcttgtagttctaataatttgtctgttgattctattgattctctcaaactttgctatcttctgcatttcctctaagccaaggatcagccaactagtatttatgggcccaccacctatttttgtaaataaagttttattggcacacagccactcccatttgtttaccttatggccatggctgctttccagctacaatggcagagttgagcagtaacagggactgtatagcccacaaaacctagataaaattcttattttctggccttttacagaaaaaactttgttaacccttgacaaaatgatatcattaaatatctgaagactgtccattaaaatacttgttatttgtggctccaaagacttgaactgggaccaacacgtacagagatagagtgtttagttcaatacaacatggatacatggataactttttagtaggaaaaacataggagtacttccttgaaggaaggtgaaaattggcttaaaagatgacattataactaattgcccaaactggaaactattagctcattacttcaggaattcaggaaaaccagtaccgtccagcgcaagcagaggtatttggcctctctgcctttaaatgagacagtcttcttgaaaaaggttatctctgcattttcaatattgaaaaggaaggaaggtggtgcaggtttgattaaagtcaaatcataagatttattttcatctctcacaggtttctgaggacaccttaaaaccttgactgtaagaggtgatgtgacaccttgagataccttgcctctcctgttcagcagtggggaggttcttgtctcaacagttgttgccccatactctgggaattcacctactggatggtggtggtggtagagaagataacttggacagtccactagactacatatatctccttcaacccaggggaaaacatgccttttttcaaaagggcaaaatggtaaactcagtcaggtgaatttgtgtgactaattggatatttccaaatgtttttaggttagtgatatatacatcatatgacttgtttctcaagaaagtcaatgtggaacttttcataaaacaatttttgcctttttttttcaggagaaaatcccactctgtggaagttagtaaatgtcccttctgtagttaaatttagtaagcacagatgccagctaaggcaggtgttggcaaaaatcttatggcacgcaactctgcaaactggtctccttctgccaacagagtctctgcaaattgtacttaaacaagcacgatgtgttgctgatttctctttcatattctctaaattgccagttgttttgttaaattctgtgttcttacagacatcagcatcaactttaataattgtccaggttttgaaggagatacagttgccacaagttcttctacagagtccagactctggatggacttggtccctcaagttgggactccattgctagtactctcccaatgactagcccttaagatatgtttattaatgttaggtggaacttcttgcttttgctcatagttaggaaagttgttcttaaagtgtattcttcagaccagcagcatcaacatcaccttggacttcttaaaattgcaaattcataggctgcatctcaacttactaaatcagaaactcaagcctttcagttgatttcaagtttgagaaccattgttttaggaaaaatacttaagaactgccaaccgtgtcttcctcatgaaatcacctcttttggttattcaataaacagttattgcctgcatgtgccccattactaagccatgtgctgaaaaagagtagcctatgaatgtcatgaatataaggatcagatctgtgttaccacagtgtgcccccatttgtgggcactgcatatggcttattattggtgtcaaatgaatatttacttatttaatttattggaatattaatacaactaagcccctgtcttctaaagactttgatatatggaatttcaagtgccgtaaccttcattactattgttgtatctctcttactccaaagaatataaaacgttggcaatgaattataatgaattaagacatttttactttatgcataaaattatgttaggtgtttttatttagatttgaaagcaagagttgtctttacaggcaaatcatgtatttcatatagcagaaaagtatggctgaggttgtatattttggttgaactagactaaattatatgtgttccttacttctactttgccttggttgtgtagacctgggtaggtctttacatcttcccaccttttttaatagttcgaagatgaaaagggggttctggagcaattccatcaatgttcgcactcttttagcctacttctgtaaatcactagagcagctgtgcaccaattaattgcaaaagcgtacaggtggtcagcagaatgacttgataaatgcactcttattttaaggggcctttcatttcttacaaaacaaaaaaggaaacagcttttaaatttaatgcagaaagtaaaggccaaaatagttaaaataaaaaaattagtcaaataacaacatatcctgtgctagttgtaaccaaattaaatggaacagttcacaggtgttccaaaacgatgttcataatattgttgaagaaaattgcttctcttgtttttatgactttaatactaggccaatctttatatacagtgaaaaatttttaaacagcagtgaaatgatgccattctatctctgatccttctctttatgtactgtactactgccatatatacacattaatctattactgatgactctgttattcacgttcctgtagccataaatatggatcactgtgtatcaatccagaaatcactcactctgtgtgactagataaacaacatatacagatcattttagtaaagaatgatcttaagtgagtgaacttgtactagaagctataattatacttaataaatgacttctatgcctggaaagaagtatatgtttgacttaatggctattatatatcacagcataaacactgcattcctacatcttttcctcccttcaacaaatccttacccatcacattttttcccatattactggtattgggctaagatttgtgaaggatacagaaaaaaatgagaagaatttctatccctaaagcaggtaagagaacaacagaagagatgctctctgtgtgtgtgtgtgtgtgtgtgtgtgtgtgtgtgtgtctttctgtctgtctgtctagctagctagctataaagatgatagaaaacagcattgctatttaagaggtaccctgaagtttatatgtaaaatgttttatgtcagtagttactcactgaacacctacaagtgaagagcctgcagtggaagttaggaatatagctatgaaaaagacagacgcattatttggtgtaatatgttttgccatctaaatggaaggcagacactaaacacatgaataaacaagagaattataaattgtgataagtaacatgaagcaagcaagacagtagtagagaataactctacttggtgtgggcatgagaatatgcccacacaaagacttgcaagtaaatggtcatggaagcattattggtaatagctaaaagtggaagccacccaaatgcccatcaactggtgttatgggttgaattttgtccctcaaatagatatggtgaagtcctaatacccagtgcccctgaatgtaaccttatttagaaatagagtcattgtagatgtaatcagtaaagataaggtcatggtagggtaagatgggccatagatccaatatgactggtgtccttctaagaacacaatgggaagacacacatacacagaaagaatgtcacgtgacaaccgaggcagagatggactgacatgactataagccaatgaatgccaaggattgacagctaccaccagaaggtaggaaggattctgcccagagtctcaaagggtgcatggccctgtcaacacctttatttatgacttctatcctctagaactgtaagagaataaatttcttttgcttagggccactgagtttgtaatgctttgttaaagcatctctaggaaactaatacaaccagcgaatggagaaggaaaatgtggcatatcctacagtggaatattattctgcaataaaaaggaacaaactactggtacctgttacaacatcgatcaatctcgaaaacgctatgttcaatgaaaggagccaggcacaaaagaccacatattgcacaatttaatttataggaaatattcagaaaaaaagcaaatgtacagagacagaaagcagattagaggtttcccagggctgagactgggaatggggattcattgtgaatgggcatgagggatcttactggggtaatggaaatgttctaaaactagattgtggtgatagttgcatgactcagcaaatctgctaaaaaccattggattgcacacttaaaattggtgcactttttagtatgtaaattataccttaaaaacttgttttttaaaaaaaattatcaatggaaacagacaaaggtagaagtttttatcatttgggtcatttaaagaccattgtgggctagagagtagggcctacagaggagagggaaaggcaggcagtaagtaggtaaaggattctgggagagaaaatgttcagtttgggcctaaatagataggattttaggacgcggagataacagttcagggatctgggacattgcatctctgcgttgccagtgatattttagttctttcaaacaaggttgtgtgacatatatttgctccttggtggaattttcatgatcagattaaataaacacaattttatatgtgatatttatagacagagagaggctgggaaaaaacctgaccacttctaagacctccttggcttttgtattctaaccttattgtctcatctccctctaacacatgatacactgcaaggcaggctgtcttgatttcctgggaagacgaaagacctccttctctcaaggcaattctttttaattaacactgctctcagagtatacagccatatacacagcactaaaaggtgttaacttgctcactgcgctcaaagtcatactactgatatttatgggatgatgattcaacggtacgggctgtttgttagcaagttcaacagctgtgtgtgaatgttgttgtgagtatgcactgagtctttaccaggccagctttgtgcagatgctgaaagaaaggccagcccagactcaggggcaagagaactcagacagcagaggctagcccagaaaggaggaataattttgtaaccgaacatgtcaagcatgagtgtaatgtatttgaacctacttttgtagtgttattcatttcgtggtgagaggccttcgtaagagattaagatgaggagtcaggggcctgagtttcaacaccgactggttttctgtgggactaaagataaaccgtttaactcttgagattacagccttgcttgtaaaagaaagggatagattagaactgtgatttttaacctatggagggataagcgtcccttcaagaataggttgctagccgtggatcctctctttagaaaaatgtgcatccaggaggaaattaatacccagattaaggttgctgaaccaaatgatatcaaaggtcccttccaaatccaacactcctcatcattccaggaaaggaagaaaaatgaaaacaagaagaagaactattatgttcgagtttgcactattgacaacatactttatagcaaagttagctagactgtaagtcatcagacacccagggttgattctgtttctcacagtttgaggagatcctcttgatgcttctcaaactctgaaatggctgatgaaaagggtcacctcggtggggtgcggtggctcatgcctgtaatcccagcactttgggaggccgaggcagacagatcacctgaggtcaggaattcaagacgagcctggccaacatagtgaaacctcatcgctactaaaaatacaaaaagtagccatgcatggtggcacgtgcctgtagtcccagctacttgggaggctgaggcacaagaattgcttgaacccgggaggcggaggttgcagtgagccaaaattgtaccacagcactccagcctgggcgacagagcaagactcagtctcaagaaaaaaaaaaaaaaaacaggcaagggcccacctctgcgaagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccagtgagtgaaatcatttctctttgtgattgcacctgtcccccatccattttttgtctttaacctttccttctaaggttcagtctctttttcctctgactatgggaagcctaaaggagagatgaaatggagagccctatctttttatagtaagccaggtaattccaaactctttatgggcacagttgaatcaaagatcataaaaactgatcagagatggaataagaataaatgtattagaacaattagagcagtggcaaattgagtcaagcatgtattgataagaaataattgataaggccaggagcagtgactcatgcctgtaatgccagcaatttaggaggccaaggcaggtggatcacttgaggccaggagttggagaccagcctggccaacatggtgaaaccccgtctccactaaaaatacaaaaaaattagctgggcatggtggtgcacaactgtagtcctagcaactcggggaggctgaagcaggagaatcgcttgaacccggaaggcagagattgcagtgagccaagatcctgccaccacactctagcctgggtgacagagcgagacttcgtctcgaaaaaaaaaaaaagaaaaaggaagaaagaaataactgataagtatttaattgcaaagcatggacttagtttgttagactgtgttaccttgggcataattgtagagtcattttccgggatataggaaaagtgggagaatatgaccctccaaataagtgtgccattggcaaggtaggtgtaacttaaatgttttctgtagctgtatcttgttattcttttttcacaggtccaaaatgtaataaaaatacaggcatttgatgttaccttgaatatactaatttatgattcatttatattggccttggaaatgaaagtaaaagttgtggccacagaatgattactcagaagaattattttattatatagacataattaagcatgcaggtatttttgagtacttttattaataaatcttacaaatttttctgcagtatacttccaaagagataatttaattttcctgatgactagcacttcatccccttctcctttttttccttaagactaccttaaaacaatacttttgaggggcaaagttgtatgcatggagaatttaatccaggcaaatggtgtggttctgcgacacaaatttttctgtagcagtaactgggagaagagccacaattcatgactgctggagataggacctgctttaaatgaaggaattaattgtgcacataatgatgtgtataagcattctgcattaacagaaaaatgagttttacattttatacattttaaaagaatctccaagacttagcccctttatttattcacaggagtgatgggtgaatatgagcccaaaatagaagtgcagttcccagaaacagttccgactgcaaaaggagcaacggtgaagctggaatgctttgctttaggaaagtaagttctggtttgcgttccttctcatcctcccttcagcttgagcaggtatagagtttttcttgcactgttcacagcgatggtttctgaggtgacggaaaagcaagtgaagcctttctctttgtaattctgtgtatgcatcttggattctgcccctcaccatggagagaggacatgtaatggtgcaagaaggattaggctgccacaactgacatgaccacaaaggaaaggagaatgggcaattctgaaaaagtattttgttctattatcatgacctgtaatgtgcatgctgtctaacccagaatgacaggaaaacaatggcctccacttgaggtacagttaagctgactatgtggaaaaatacggactttcattttggccccagtttatagaggatgcatcagacttttcttgaatttctttttaaactctcagtctcttctctctactttggatttccttctcctctggctagagataggtaagacgtgttgttctctaagagagtctgttttacaaagttgtccaaatattgtttacaactttattattcagtgtggacttccttgagaaaagcctacttctaaactagctaacttttccttacagaatatatcagacagcataaagaacatgaaatgcacatcatttgggatttttatttgccagtaaccagcaataaagatttggcataaacagtataaactattatctgaagtgagaattttgacatcttctttggattttaatgatccgtgtcaatctttatgcccagccccatctatctgacgaatccattactaactctctttttcctgcgcccaaatgttgactaaggcaacaacagtaactttttttttttttatttttcggtagaggcaggatctgcgtatgttgcccaggctagtcttggactcctggcctcaactaatcctcccacctttgctcgtctaagtgctgggattatagtccctagccactgagccaggcaacactaactccaccaatccttatatcagcgtgtaatctcttttcttatgatttttgtgttttacagcaatcatagaagaggttcctttttccattttattgtcggttctaatagaaaggttgttttggtttccatgtgttttcaagtcgtgacaaataagctacagtcgtatctttactttggtacagtacaatgcagtggtaattttttatgtcctgaaaacttatcatattaaataaattaagacataattataggattgaacactctacagacattaaaagtcaagttgcaaaacaacatttaagacatagaaaatgcccatgctaagagaacaaaagcagattgctaacaggataatatgattacactttttatttttattttaaagtatttgtgtataagcatttatatatatgaaattaaagatgagagcaggtaactgggtagtctagatatacatttgatgaattttttaagatgacaccttgaaaaatcatctgtgaaaaagagcagaattcacgttgttcacacttcaaagggggttatgaattaaactctattcacactgtttgaatagtgctggaataaaaacaaaaatcccaaattggcttcttcagtctacacagaaatgtttgggtatgcacatccagctgctgaaacacatcatcactgcccacttaagagcaggaagactacatctcagtatggttatttttaaaggcatatattaagtgcatatctcatcagtataaagacaccgattatgtacttttcatagaccttttctgcattttgagttagtgtctgtctaacgaacttaaattcttctaaaacaaatatagtagagttgatggctttaatgttttaaataccatctcaggtttcccagagaagattagcaagtctttagtctaattacttctctgtgtgtgtatttgtgaaaaataaataagtaaataattgtatcccctgccaggcagccacaatcttaaaagctgtggttagctcactaaaccattgatttgcagattcaatgatgccctctctgcaatttaagatttgttccaacagttatggcagtaggatgatagatgccttgagagtacataaagacctcacagatggcatctttctttctctcactattttaagcgaagtttccccaacccatcttgcaaatggactgctgtaagttggtaaggttctcaatatataaatgacaaggagaaaaaccatgttgtccaaaagaatgtaccttgagtgaacccttcctgtatgtcagcaataggttgtgtctcccaaattttatgagctcattatttctactatcatttattcattatttggatatttctcaaagtagggcacttgcattgttggtacatagatttatggaaatatattgtttctgttatctattgctacataaccaacttagagggaacaccagaattttattatatcttacaatttgtgggttaagaattcaggcagggcttggctggctgattcttttgcttttagtggcatccttcaggtctttcagtagtatttagctgacagatgaactggtctagaaagctcacaagagtctcacacacatttctggtattttgttggggacgttggaaggctggtgtcactgagactgttatctggaagccttacgtacggcttctccttcctggcggtctcaaggtattcactcttctcgtaggacagctcagggctgccatgagacagaaagcagaagctgccagtttcttaacacctgagctttgatcctgcaacatcacttctgtcttatttattagtcaaagtggttaaaaagcgctaccagattcaaggggaggggccatagacctcatctcaatgggaggaatgtgaaagaatttgcagctatctttaatttgccacaaatgcacatgaacatttttattttcatattttttatttagaaaaaaacatgtatgggtgaaaccttgtctctactaaaaatacaaaaattagctaggcatggtggcgggcgcctgtagtcctagctacttgggaggctgaggcaggagaatcacttgaacccaggaggcagaggttgcagtgagccaagattgcgccactgcaatccagcctggtgacagagtgatactccgtctcaaaataaaaaaaaatatattaaaaaaaaaagaaaagcaaaaaacatatgaggaaacatatataacatataaaaatctgtttttatttcaatgatgatattgtataggagatagatcacttttttttttttttttgagacaaagtctcgctctgtcgcccaggctggagtgcagtagtgcgatcttggctcactgcaacctccgcttcccaggttcaagtgattctcctgcctcagcctcttgagtagctcagattacaggcacctgccaccatgcccgggtaatttttttgtatttttagtagagacggggtttcaccatgttggccaggctggtttcaaactcctgacctcaagtgatctgtccgcctcggcctcccaaagtgccaggattacagatgtgagccattgcaccctgccagatcaccttattgaaagttaagaaaagttatttgattttaagaacactaaataagtaatgctagagatgtggatatgattaaagttataatggagatagaggaatgaatgaagtttgcaaaacacccaaccttatatgtgtagaaccaagaaggaagcgtttaggttcagataaaaggtccagttttctctagtttgattcactcctttttattcttgctatcagtccagtaccaactattatctggcgaagagctgatggaaagccaatagcaaggaaagccagaagacacaagtcaaatggaattcttgagatccctaattttcagcaggaggatgctggtttatatgaatgtgtagctgaaaattccagagggaaaaatgtagcaaggggacagctaactttctatggtaagtgtatgatttcagtttatcatttatagtgctacagaacttcctgatattgaaatcataagctgagaggcattcaggcattttgggagagatggtgcagaataggactgtgtgaaactcatggtttgctccataatcagccctggttgattctgggtgtggagagtgagggtggggggcaagggtgttgacggagcagagaggaagacattaggctgatgtgtttggaggatgggtattagtgtgaacacacttgcaaagaagtctgtttttcctctttgcatcaagctgtaaacctgacacaggaaacgttttattattcctactcctgatttatctttttttttttaagctctgtgcttttcttcattagaattttgatttgaggcttgtgctaatcttttgtaattgctcctatttgttagcaatttaatgtggtaccatgaacatttcaaaatgcacactgtccaaatttagttcttatcagagtggaacgtgacaaatctctctcaccccaaagactttttatgtgcagctgctcctattccaatcaaatcatcagcattgatccaaacaatataaatgtaaaaccactagcacatggtcattattgagaccatcttggaaaccctgttaggatactgatttgaaatctcgaaaaggatttcattggataggcattttgaaagcaaactgagttctgccaaattggagcatgccagaatcccatctgtctgggatacagaaaacaaatactatagattgataattatttaagaatggtttaaacaaacaacaatgcatattaaaatgatgagagtagttctgtagggcaagttgtagcaaaagctttaaatgttcttatttcttgcagtaattgatcccacaaaagtctatttatttcactaattcttcttccaaagcattttggttttaagatatgaccgaagttctaagccctccagtagacagaaggggacccctcttggctaagggggggcccagagtaacattgaaaaatgagttcttggccatgatgggagggtaatgtcagacacatctagttatacctgctcccttgctaaccgcaatgagcctttcttccctaagggctaaacacaatctagccctttgaaaagactccatcactgacatcaaccatgcacctgatgctgccccttattttttgcctgataagagaccaccaacacagaatggttctgtcattctagggaggatgtgccgtgaggggtttcatgtcctctggtctaccttttgacatcacagggccaaaacctccaccctcagatgctaatactgccatttttcatacccggaacccatgaagggttgcacatgcagatggttctcctttcataaatatccatgactcctcctgtagcttattaaatatgtatattcatatttatatacatatgaatatgtatataaattcatggcttctgtgtatgaaatatacatatattcatatttatatacatatttatgtacatatgaaaatatgtatatttcatacacagaacccatgaaactcagttgcacatgcacatgtttcttctttcataaatatccatgattcctcctgtagcttattaaatatgtatattcggccattccactcagcacaaattcctgtttgttccctttgctcctccttggaagtgcctgtttacagcttctggccaagggaggctacgcttcctagcctgtcagaatggccaccaggcagactaataaagctctcccttccaaaaagaaagaaagaaatggaaggaagggagggagggagggaaagggaaaaaggaaggaaggaaggaataaaagaaaaagctatggccaaagaattctgatcgataatcacgtaacattttttaaatcttgattggaaactgggcagagatttccactatgagccagccttcaatgacctcccctaagtgactctcagcatttcattttggactcacgttcccctgatgcagcttctgaggggagagaacacacagagttgtagaaagtattaatacttcacttgatgagctgggcagtagctgtttgaatacatctgcacttctcttttatcattcgtctgtcttcaagaatattaaaggactgactctcctcatgccagatgacagacttgatatttaatctttgctttcctcttaaactgtcatagttggtatcttagttgatgggttgtaaagcaaaagacaccacagttaactgactgcaaaatcatgagactgtaaattacagatttattcagtgagatgctatggctgtgtatttttaactgtgtagggctcgtttttctcaccaatgtaataattattttttctatatcagataggaacaatctgtaaatattcagataattggccaacattttctcttttttcttggttgaatagtctcttcagttcagtggtggctgttcctaaatgttatttgagtagcttaactaattgaataaagtcattttaactttcatgattttctgttaactgaaattcctgctctcagtatgttaaactggtatgaaattttctgcaaccaggggtcggcatactgctttcctgtgggttagaggtttcctgcactggaaatacagtactccaggattactgttatggaaaatcaactttgtcactggctcccagccctgtgcagggaaatgtttttttcagggatcctgccctggagatgaaaatcaggttctaacaatgtttcctttttaaatggagttatctgcagccatgcatgggaaaaagagcagaataaaataaaatttgcctgctttctgaagataactcagccttagctcacttgtcagccacgcttggtgttaaaaacttgtcagatcagttgacttccacagcacttggctattgcatttatgtttattcttttgtttttcctcatctagcacatcagtgacaaaaattatctaattgttttcattgtcacagccacaggagagcttaattatacataagcacttggctgtcatcttttttcctctcacttttttctggtctgggtcttcccagtgctgtgttcctaatatccagctgcataggtctccaatttaaatgaattatgataattaaaatcaccatgtagatgataaaaggtgagaaagtaccccagtcacttatccatgaacattctgtctttgttgacaagaatttcttacaacctaggaattataaaccatgggtttgagcttagaaacctgcttctttgggttccaggttgtttattgcattcatcagctctccacttcagcaaccagaagtgtgctaactcctattcagggttggcaaaatggcaatttttttccttcttgcattaaaaccattttgcattaaaaccattttgccttctttcaaaagcctactaggcatgatgattgttcccagtgtctgaataatggaagccctattgccctttggtttgtccctactgtagccatgtctttaagttaccctgtgctactcatgtttggtatgtatgaagaactgaagcaagttcagagatagaacatttttaccctaccccatcttcccaatttgtttttgctataacctgtacggtctagttgaatctacttttctcagtctgtttttggcattaaaaacttcctaaaaatagatttattttcagtggtaaaatgctatggatctctgttactaaagataaacattttccaaaatgactttaatacattatttacttgtttaacaaatttttttttattgcctaccatgtgggagacattatcaggcactatggctgcaagacaaaatccctgccctcaaggacctaatattttactggaagttaaccaaaatgcactattaagcaaataaattaactaggaaattttattttttggtaagagtgataaagaaaataatgaggttgattggccaggtgcagtggcttatgcctgtaatcccagcactttgggaggccgaagtgggtgagtcacttgaggccaggaattcgaaaccagctccgtctctactaaaatataaaaattagctgggtgtggtggtggtgcatgccggtagtcccaactacacgggaggctgaggcaggagaatcacttgaacccaggaggcggaggttccagtgagccgaggttgtgccactgcactccagcctgggcaacagagcaagactccatctcaaataaataaataaataaataatttgatatgatagaaagtagctgagagcaagagaaagatttcataagatgaagtagtcaggaaagacttgtctgggaattgccctctgacccaaaacctaaaggatgaaaatgagctaggctttcaaggggaagtgcattgctggcagaaggtgaggaagtgcaaagactctgaggcagaaaactacttgactttcttgatatgcagcagggaagtcagtgttaactaaatcatagtgagcaaggggcaaaggtttgaaacttgggaaggtgacagactgcagtactttgtaagccaggcacagagtttgggttttattctctgagtaaaatgggaagccattacagcatttcaaggcaggagggtgactcgatttgattaatgttttgaaaagaccgctcaggttgttttgtggtgaatggatgattggaaaccaagagcaaaagccggaccattgccaatatccaggtgagagacattgttggttaggacgtaagagaggaagagaaatggagagacttgagatatattttggagttagagccaataggatatgctcatttcattcctacatctgtctagtttatagatatggaaattgagtcccaaagagattaaagtaattgatttaagtttatacagtaaaaaacagagctagatttcgaatgctttgctagaggttctgaaacttcagtgtgcatcacaatcacttggaagtcttattacaacacagaattctgggtctcgttctatgttcccagtgggaacataccagatggaggctttgatttggtaagtccagggtagaaccaagcatttgcatttctagtaagttcccaagtaatgctgatgctgcttgtctgggaaccacatagtgagaatgctctatgtttaggttgtccacccatggtattgtgaagctgaagattaaatgacatgcaagagaaggtgttcctgctactctggaaagctaacagcttactgtcacatcaggcattttagccagtctacacaaagtagaatgagagcgctaaggcaattatctttgaagaaaggaaagggaaatataaaatgtatttaattcacttggtaattattcatctttgcacttcattctgtctctgtagtcacttcctttttgcccaaaaagactgatagaattatagtcatcatttagtagaatgaagtgtgaactacaagagcctgatatttaatatctttgtacagtttcttctctttgtaacaggtgttatgagagttaaaccatcttcataattaggaaatggggaatctaatatttgagcagtaaacaaggctgtatttcacagaatccagtaatacttaagctggaagcaactgctggggccaaccctttgatttttataattaaggaaaataagatccagagatacaaaataacttattcaaggtaatgcagtgaatgggaatcacagctagaactgcttttttctgctattctacctgtgttacttttcctgccaatacaacattttaatacaataggtaaggtgaaaaaaatccatcaatcatccggatactctttcttgcgttttccattaccagtgtcacaaatgaaaacatctggatgaacaactgactttttcactttctattttctaagttggtcacctggttattgagtccaaaaaaaccctttttttcttcttcaaattacatgtaagactaaatgtctagagcctttgtgctacagtcctttgcctctaaaggcaaaactgtaggcttgatgacactgcaaatggtgtttgagtatctctaaggtcatcaataaatgaatacttaagcatcttacagcagagcatactaattccccatggatgtgctatgtatatgtgatcacaagataatattcagccctgcaaagaagcttaaaggacagagtaaccaaagactgaacacagtacataaggtaatttcacagtagggcaatagtttgcttaattgtcctagacagaactgatattgataccctcaattcccctgtcacttaagataaagtcaacaatttttgtttctttctttcatctgatagttccaataaagtatgttgctacagtttttaaggggtacgcattaagcaaacgttgcgaataatagagagaattaatacaggagtggaggcataaagtcctcacctaataagaaacgttaagccatgaaaaaaagagtcatatcaaggacaatatattgaaatgcaattcaagtcatctcactctatagtcccagagaaggcaaaatgtcacagttacatttttttattcaccaatgaatattgtttaaatttacttataggaggttttgcttaagttgattcatttatctagaagttcctctgcttgtctaagcaggagggctcaaactgttggtttaaggactcctttttaccctgaaaaattattggatacctcaaagagcctttgtttatgtgagttatatctacccatatatgccatataattaatttaaatggagaatttaacttagaacttaatttactttaaaataacaaaaatacaaccagtatatgttagaaataattaacataagaaaactgactatatttttccaaataaaaatatttaatgaaaagagtagcttggtttatatttttgcaaatctctgtaatgtctgtcttactagaataaaagtgcattctcctatatacttctgtattcagtctgtcatgatattttgttttgattgaagtatatgaagaaaatatggtctgacacatatataattggaaagagaggacataatggactctcttaaggaaacctggggacctacaatggttcttagattgcactttaagaaggatacattcaaaagaatgctaccattgtcatttgtgttagggttggacattttttgagaggctctggacagagaatggatgttggagccaagcaggcctgtgtaccattgctaactgagctactttctgaatctggatgttaatgtctctgggccttacctataaaatgagtacaagtctacttaacctgaatattattatgaggtttagaaatgatgtgcataaagtgaagctgattagatattccatatattagtagtttccattattggttgcatttgggactgaactcaaggtgtataagggaaagagaaggggatggattcagctgagtaagagcagattgagggaaacactaggtagaggctttgaagattaaaaaaataaaagaaagaaatatagagaaatgaatctgtgtaaggttagagtcatagcttgattgatctgggtataactgagtaaatcgggcccaacagcctttttgaaaatccacatattgctgatttacaatgtttttattctataactcatttataaagttctgaactgacttattggagtggaggacaaagacccttattcaccaagagctgtgaattcaatgggcatagttggacagaaagtaagagatgtaggtaaaatcagatggcagaagacttcattttcatttatgtatttgttaatttattttcgagacagggtcttgctctgtcccccatgctggagtacagtggtacgatctcagctcaccgtgattctcgcgcctcagcctcctgagtagctgggactacagacaggcaccaccatgcccggctaatttttgtatttttaggaaagatgaggtttcaccatgttggccaggctggtttcaaactcctgacctcagatgatccacctgcctcggcctcccaaagtgctgggattacaggcatgagccaccacacctggtcagatggcagaagactttcaatattaacctaaagatatgaaataatgataatgttctcctaattttcataacatttacaggaggcagagcacattcagaaatcttacttgttatctcgcatacagattacttcctacagttatatttgctttatgtattcatgaatacctattaatagaaatatgccagctttgagttgccttctagtgtatcttcatatagttggtttttatatctgaacttgagtttatccttgctatccgtgctatctgtaaaaggattggcctatgggagatgccatctcccataccattgccagaagcaagtcagttgtaacttatgtggagatgaagaagccataaataagagtgtgtgaatgaagtacaaattaacagaaaaactaggagaactatgaatcctgttggtttaagagacaatctaaaggctaaaggtttcacttattaaaatcaaaaggaggggctgggcgcagtggctcacgcctgtcatcccagcactttgggaggccgaggcgggcggatcacaaggtcaggagatcgagaccatcctggctaacagggtgaaaccccgtctctactaaaaatacaaaaattagccgagcgtggtggcgggcgcctgtggtcccagctactcgggaggctgaggcaggagaatggcgtgaacccagaaggcagagtttgcagcgagccaagatggcgccaccgcactctggtctgggcgacagagccagactctgtctcaaaaaaaataaataaataaaaatcaaatcaaatcaaatgaaaaggagtgttagacatcattaggtccaaacgaatctgaattcaaggagaaaacaggcttccaatccccagactgcatttccaaagccgttcttataatacaagatatcagccagtatcagcaaagtatgtgtatgtttctcaaggtactttttttagcatgaaatttcacaagaaattctcaatatttaatacaaagcaaggctgcagcaaggaagcagccttgcgttgtgttaaatattgagaatttgaatgaatgtagaagggagtgccttccaagaaccctcagagcttcatggaattgagtttgaagacccctgtaaggagactgattggtgtgtggggagtggatgagagtctgaagccagagaagcacagattatcagtgctgaacaaacaccaaagatggaccttgccctgaaatccaacatgcatatttcttgtagagctggtccttcttttcagtgacttctgccaactggaagtcaggggtttatgagaagactgtaataataaactggaagactctcttaagtagcattggaaaatgactatttctcgtgccaatactaggaacactgaatttgaggtaatatgagaatttcttgatgattctgtcaattgcataagaatcccaggcaggagatagagatttgggaagcatctatgtatataggtggtaaactaaagccaagtaattatctccagactcataaagtctactatcattaaaattcttcagcaatgtcagtgaaactcccgcattccctggagatgattcatcttctccaaaattgtgtccgcaaccagaaataactgtgaatgtctacaggtcatctttgtaatagtaatttagagggttttttttttttttttttgctatcacatcctttcttttatatttttaaatttctaaggcctaaggcatatgttggcatttctttcagttagaaatttctgtttttagaaaatcgaagcgccaaatactcctgagaattgtttgacccactgagtttaaattatatctgcctgcaatataaattattattggataagatgcttgtacaattccagtggctggaatacacaaacgctgatttaggtcatttctggcagttattgaacaaaagattgaaatgaagagattgtttatctatccaagagacaaagtgtgtcacagagtcaaatcccagcacaagcatttaacattatatttgaatttgtagtttgagaacaatacttaaggagtcctagaagaattcttttgtttcaaatcttgaaagaatatggaagttcaaaacagatggttctcttttaatatgtgaatgtgtttaattctgcttaatatgtgggctctgtatatattacaaaaaaaaaaagacatttagaaatggcttctgaaataatagtattgaactaacctgttcaggccttcctctgagttgatacaggttgagtatctcttacctgaaatgcttgggaccagaagtgtttcagattttaggttttttaggattttggaatatttcgacccaagcctaaacatgaagtttatttatgttttagatataccttatacacacagcctgaaggtaatttatgcaacattttaatattttgcataatttaatgcatgaaacaaagttttcactgtatttgactatgaccagtcttatgagatcaagtgtgaaattttccacttgtggcatcatggtggccctcaaaaacttgtgaattttagagcatttcagattttagatcttcagattagggatgttcaacctgtgtttagacatggagttgtaaaatatagttgaaccttgatattaggcgataaataccctgtacccaatgcattatcacaaaaggggaggggctaatgatgtgtcttataatatgcttaactgggatttttgttatctaaggactttgaactaggtaaccccccccaaatatggagatacatgagtcattttcatcaagcacatgacttcatttattctagtttgaaaaactcactcgtttagatatgattcatccaatctaagtgagcaggagtgaaaacgtttactacatgggcttttgccctgtagatttgcaaatggcgtgttaagatagactgtctctctttgtcacatatataatatgatacttcatttctgatcttcatgggcccacgttcagatattcactttgagaggaatatgtttatatcagttcaaatttgtcttctatgaattaattttactttaaaaataaagaaagtgccaggtgatctcccacagacactgaattttttgttgatttcaccttggcccgcacaaataactaccactgagtattctcatctggttccttgacctccataaccctgtgggaagagacagaatgagccctcagaagtgcttaactagttagagctttgcaaggccttttcaaaattctctccagtccctcccttctctgcctcacctgcttcttgagattgcaaggttttgcttccagctttctgcatttttgcaaaaaagcaataagaaagcccaagtgttacaggaaatctatgacattgaaatctctctctctgcatgtgattttgatgtttcctttttgaacttcaacttgacattgcttcataagttacatttgcccttccatttttttcctcactctctttcaaaagtttggcttcattgttaatattcctcacatacttctgtggcttttcttgtttgctttgttttcatggactctgtaggggtcaatattcagcaggttgaatgtgaaatcaggcatgcaactgcattagccatcaaattctccaagcagagaacctttttagcttcctttgcattagcagcaggaagataaagaacaaggaagacttgcagctcttttaagggtgtaggttataacccttcattcaagttgatgtttgttgatgttctaaatttttttgaagttgacccttttggcctcccctcatatgcagcaatgcatcatcccatcagtagaggatttgtaaaactgtgttttgctcgttgaaaaacataaaattgcttatagatgagaaaagaaaaaagcagcatttattcaagggcctagagacctctgctggttaagtgatttgttgagtgtctttctagttttgtttattattgaaaaggtgaaatacagtttggcctcaacagtagcaatttccttttgaattaaaattatggatgatttgaaacattgttgagtgaagatactgaggtcaagtcagctggaagagatgttaagaataatgagtagcatctcctaattaaatactgatatcaactttgattattaggtttaccttggtaggcattaccctgtagaaatgccctgtgaacacataaagttccagaatgacagctatggttatcttctgcatgactttgggctgaaggtcttctacctgaatatgtttatcattattcttaatggcatgaattgtgcttgaggcaagatttgatatttatgaagactttttatggaacatggaattaacattgtctttatatctattgaaaataaggaaagaaaatgtgacttcaatgaagtacagaaaatgtattatcatttgggcagcgggggtagtggatagcagtgggcaatgtgggaattaagtgctactttgaattcttgtgttagactgtgggcaggacttgatttcctgaggaggtttgataaaaatcagaactcatttaaagatttggggttctagggtcatattcctgtagataacattctatcaatacgaaatcaataataaacaatgatgatagtcttaaaggagaaaggaatcataaaattgatctatacaacatgtgggagtgaagtatattagtgagggacaagctaagctattctcacaaaggaggccccaaaataaagtagcttagatgaaaagtttatttctctctcacattattttcctcaaaaatggcaggtggatgtggagctgctttgctccacacagtcattcatggtccaaggctgacaggtcagcattttcatcctatgtagcttccatgtctgcacccaaggctatttcaattgctggtcttttccaatcagtgtgaagggaaaaagaagaggttacggaaaatatctttaagtgaataacccagaagttgctctcaccactttcacacacatacagttggcatgaacttggttacatagttacctctagctgcaaagcaatctggcaaatgtagtgcctacctggaaatataccagcctggttaaaagtgggagggggggtgatgggaagatattctctactgaaaggaaaaaaggaataatagatacttacaggagagggacagttaattttgccatatggatattggtagttttatccattttgcatttagcgattaaaagactacaatatgaaccacaaaaatggtattcagagtagggtataggcacctccctgaatgtctccccagtcttgttatttgcataacatctggaaaaggaattttattataagtgtacttttgccctttgattgaatatgataaaaatagattgagtacacactgaatatacacctttctttgctttttggatgcctatagctcaacctaattggattcaaaaaataaatgatattcacgtggccatggaagaaaatgtcttttgggaatgtaaagcaaatggaaggcctaagcctacatacaagtggctaaaaaatggcgaacctctgctaactcgggtaagcaagttaatggtaattgtgccttagtcttgactataacgtttaatatagcctcattgccgtggaaacgggagaatggtgaattgtttctaaaataatatgcaatgaaacagcattatggtggaaaaagtgagagtgaatgcaattgataaatagaaagtgcacttaaatccagttctccagctttcaattaagctcttgcactagatctgtggtcttcaaagattaacatatgtgactttataatgggaaagttatgcaaaaggtctggaacatgaaattgtgctaagatacaaaggaacatacattccagcatccactacaagagaaggggcattgacacaatacaggatatccatctaaatagagaaacactctgacaaagaaatctgaatgaagcaggggtagagcggagaccctgagaatgaggaacaattgtgtccaatttaattttccttatgtattttcctgccgaacctcaaatattaattgaaatttgacattttcctcaggctccaaattgagaggcagtctttcatgctcagatttcttcctccagtaggccacccagaaaagagtgcctgctcggagcaatggccctcacatgaatttacatgacaggaagagaaaggggactgttttgcctaactcaccccctgcctcatgcaccttctccatttgctggaagggctccagcttgtccatgattctgtcaattataaaagccaaactcagacaaattgcaggggtataggtacctaggtactggtattttccttcttttgtgtaattgttaccaaaatgccagggagttggtctaggtcctgttgcttgctgtgcagagagccaatcactgagagagtgagtattgccaggaaataaggctttgttcaggtgctttagtcaaagagaatgggagatcagtctcaaatccatctctccaaccaactaaaattgggagtttatgtagctggggaagggatgcagctgtgtgcaggaaggaattaggtgggggtacagaggcaattatgacagatgaagggtctggtgtctcactgtctggatgccatgatctagtgaatttgagtcccttgcttgaggatcagcctcctgaggagtgaactcagtgagaccaatgtaagtttcaagttttaaaactaggcaggtcaatttctgggtttattcaaaaacaggtaattatcatttctgtgggacacttgggcttgtttcttaatgtgagggaacatgaatatctagatttgatcaaagtctaataaagtgtccactcagctaactcacaaccctgcggcaaacagaaaactagtacctctttatatatatgtagaatggcaggtctcctggagaggaggagatcctttttgatacttatgaaaattgacacataagttgtatatcctcagagtgacaaataaggaggatctcctgtgccacgtactaactttgcccccttcagattggccgccaccagatggtcctcagcttaaatcacaccactgacagcaataaactaagggaatattaaactattaatacctacattttttagtaaacctcaaccaatattaaatatttgcctctgtttcatccaagattgtaatcctattaaccttcaaagtatcacctgctcaaaatgtgagtgttttaagcactctaaacagtaaatttagttttatttccgaaaccccctaactctggtcagtacaaagccttaaagtgaaaaagcattttaagtttcaagttattctatttagagaggatattaatctgaatggctccactattaaatcaatgagaactcaagagaatcctacaatttaaattccatttaccaactgatgtactggttgttccatttagcatctgacctgctacaaatttagctgacagataaatagatcatgttatgtaaattgcttatatgatggctgttttcttcccattaagcttccttgatattacacatggtaaaattgccttaaagtctcagttgtagaaggtcattgtttttatgttcctcttttctttcacaggatagaattcaaattgagcaaggaacactcaacataacaatagtgaacctctcagatgctggcatgtatcagtgtttggcagagaataaacatggagttatcttttccaacgcagagcttagtgttataggtgagtctttatactggcaagaaaaaaaaattaaaactctttagatcactaaactaacttgttctttgccaagcataaatgttcaatccaagaaaaggagtaaagaaatctttaggccaaagatgctactcaagaaacaagtaataagcaagtctataaacaataacaagagaacgctttctaaatccgcctcttctgatgcttacaatggggaccatgcttcccttggcactcatttttattcctctattgactgcacttctaaattgagcaaagtttttgagatgctttttggagtctgctgctgatttggtgcaaacttgagcttggagggaataagagctgacttggtttggaaaggcttatttgaacagctgacagaataaaccctgctcttccacatctgaatttttccagactgtgcattaatgatctttcttccaactacatgtttgatcgtgtgccacttcctccctcctcttcagctgcattgacctttctgttctgcatactcaccatcctcccgtcctctgcaggccactggtacatactgagtgcatcgtctgcctgaaacgcttttccttcccctcttcatttctgtaactccttctcagttcgcatcttccatcttcattggtgcttcctcagaaagtcatgcttgggtcaactattcctattacagatttttatactatcttttacctctcctttatgaaagatgccacagttacagtttacacttttttttgtgatctttctatctttttcttccactgcattttaacctccccgtgacgtcaaggatcataattggttcaattcatcattttattcccaggacttaatacagtattgaagcacatagtatgcactcaataaacattgaatgaatgtaagaatgaatgagtgtgttaaatgaaggaagaaattgagagattattttattaaatggattaatagattaggtcagtaaagaatcgaaaacatagttgagtgaaaagataaatctatggacgttaaaaaaaaaagttaagaccaacagcttgcattatcctgtagaaaaattttgaatttgtctattattataaaagaagagatgataatgacaactgaaaacacaaaaacaaatgcaaatgatttgggaactgcctcctattttagaggctttcagtagtcattctccttggtgagagcataatggaagactatgaataagagaaaaacagcacacaaaggagctaattcacgtgctctgataaattgtccagtttcagagtcctgactttcccttatgaaaaacattcattggtgcctagcatgtaaatcttgcatatagaagtaaatgttctcaagtagaatgtacttccattctgtgcaatgtaaaaaaataaaaagaaagaaaaacttccacactgctcttctcactaagttcgttagcactgactcaaatcctatcaaagataacgattgtgagatttcatggggatggagcctttttcaaagaggcctagtaatggttttatgctcttggcatagatagcatcagcatggctaggcctactggaatcctaaacacacatacttctcaccctataaatattaggaacaataattttcaaccccttccaggacacatatgatgattcccttctgcccggatttgctaactattggtacttggaactgagtcttttggagtacagttcaccatggcaggattgcttaggagtttattccaaaacaagtgtgttctctactctactctatatcagctagttggaagaacagctaaaagtgagatgtggcctaatgaaatgaatcatagtgtctgaaaaccctctatatgagcgctagccaatttatcagtctagggacccttttataattttaagagattttgtagatccctttattaaaataagaaaatttgatagaaacaaatgactccaacaaagtgagaaaagctgcttaatgatttatatctagagtgcctacccatagctgaaaataacagaatatatgtgtatgcgtatgtgtacgcataatggcttaaaaccactctgcacagccctcccctctctccctctagtactaggattcaaggcctgttagctgggaatcactgttccaacttttacattaaggagtttatttaaaaatcatttccaattggaactgtctaattacaaatgaatttttgatctgagctcttaagtttcccgacgccagcaaactagaagtgttagtctgtttaagctgctataacaaaaatactgcaaacatggtggcttatagacaacaaatgtttatttctgatagttctggaagctgaaagtttgagaccagggtgccagcatggccgggttccggtgaagtcccccttctgggttgcagactgccaacctctcactgtgtttgcacatggcagaaggggtgagggtctcttgggcctcttttataagggcactaatcccattcataaggtgcttcacccttatgaagggcttcacctcataggggcttcacctcttaaaggtcctgcctcttagtaccatcaccttagcggttaggatttcaacataggaattttggagggacacaaacattcagactatagcagtagagcagtcaagataaaatgaaaatgcctgagaaattatttaaccatgtttcacataagaacaataaaggcatgtcatcaaattatttaggccaaacaagttgtaaaaatgtaaggcttgcaggaattcaggaaagggaatttggctagggggctgggctggaaagctaagccctgaacaatttagattttgacaaacacaaagaatagtccagatcagaatgaaatggctggaacaaaggctcaaaattataaaatatctgggatagtttcctgcacatagagaatcttcagtgctttttaaagctgttgactcctcagtggatgaatgggcaaacaacatttggtatatgtgaacacagtagaatactatgtagccataaagaaaaggagaaaatcctgtcatttgtgacaaaagggatgaacctggaggacatcgtgctgtgtgaaataagtcaggcacagaaaaatatcacatgatctcactcataagtagaatctgaaaaagtttatctcaaagaaatagagtagaatgctggttgtcagggtcgggggaatcggcgggggagggttgggaagatgtcgttcaaagaatacaacacttcagttagatgggacaaatacattcaagcactctattgtataacacgatgattatagttaataacaagatatcgtactctcaaaaaatgctgagggagcggatgttaagtgtttcaccacaaaaatgataattatataaggtaatttatgttaactagctggatttaatcattctacaacgtatataaatacttcaaaacatgttgtatgtaatagatacaattgtgtctgtcaatctaaaaagtaaaataataaaaaaaataaaaattttgattcaaatacataaagcatatatcggaaaatttaaacttgaaaaagaaagatggtggccgggcacggtggctcacagctgtaatcccagcactttgggaggccgaggcaggcggatcacctgaggttgggagatcgagcccagcctagccaaaatggtgaaaccccatatctactaaaaatatatatatataaattagccgagcatggtggcgcatgcctgtaatcccagctactcgggaggctgaggcaggagaatcacttagacccgggagacagaggttgcagtgagccaagatcgtgtcattgcactccggcctgggcaacaagagtgaaactccttctcaaaaaaaaaaaaaaagaaaaagagaaaagaaaaagaaagatggagaagtcattaaggaccaattttggagattcttgaatgacaagcttgcaagttccctatttaatatcccattttcccttccaaaaattcccagtaatatatttcaggtaaattgaagggcagttaaagattgagtgtgtaaacccgtagagtctctcttaagtgaataagggagaagacatctgcctatttaaagatacatagaaattaatattggttaacttgggtaagacataatatgattgttttccacaagtcactttgttccttatatagcaggaatagtttggctcttttggatcaaataactaaattgtcattacctatgctagaatcatgaggatgctgaattgaacaaagaaacaaaatggaaacaagataatctcttgttaagattatctcttggccgggtgtagtggctcacgcctgtaatcccagcactttgggaagtcaaggtgggtggatcacctgaggtcaggagttccagaacagcctggccaccatggcaaaaccccatctctactaaaaatacaaaaatcagctggacatggtggtgcatgcttgtcgtcccagctatctgggaggctgaggcaggagaatcacttgaacccgggaggcaaaggttgcagtcagctaagattgcaccactgcactccagcctgggtgacagagtgagactgtctcaaaaaaaaaaaaaaattatctcttgataatctgtataagaaagaaaaaatatatatgttggttccacctattgattaaatatcaggaacctccaatgctatagaggagattccttttaatgttgggtgatagccctacggtcatgaataagagatggttaggaagcatatatttaataggtttttcccttggttttattttatgtgttctgtcttggtatttaatgtgtatgtaacatgtctatttaatggatttaaactgctaaataattaatctgtgtgctgggtgatttactcactggatgggcaaacgccatagagagacttttatcttgaggtcagtatattggtaggcctggttatgagtacatcaaatggaagtgtccttgtctgtgactgaactatgacaattggcagtttatttttttcccaaggcaactcctcctagatcttttctgctgtcttagcctgagtcatggatgagattcacttgtgggatatatccctgtggacatccctgaggtgctgtacaactccctgggtgataaccatcattccactcctctcccccactcatgaaggtgtattacaattagagtaaatagagtcttgtaatcatggggaaactgaatcttctatacgtaacttaaaaagtaaagataactaagttaggtattttgttggtgaaaaaataacttttctaaagtaatagttctacccatgtttagtatttgtgtccactcagatgatcatattggcgatggggactgctgattaaattgccaaacttgaaatcattgggtaaatatagaggatagctaaggtctccaaagcaagtctgaggcaagtattcaggtatctgcaattcactgaaagagtgttctccaggaaaaacctgtaaggaaaagcagaataaggaagaaggaggaaccaaacaaggatggggtcttaggtaaagtctagcctaagtctaatccagaagggagatttctggaacataaactgtacctcagacccatttccaccttgagataatgaggctagctttttaaaaaatctccatgttaatcacttcctaagctacctcttaagtggggttccagaagtggtgggggtcaaaaatctttgattttgcttatatatgtgagaatattgtgaaaaaagttttttgattttacagtgggaggagccatccctaagggtgagtgggtatctgcccagtggtcttttgaatatgacttgacttttccaggactgtataatggaggagaagtagcttctatcctgaggaaattatgtctaatggttcagtatcccgggggttctcctggcctgtgtggtggaacacatctgaccctggcaggacactcaaataccatcaagtaactgatggcccaattaaagtgaggtgcaaccttgagcgattatctggttaatttggcatctacccaggtgattggctcccaaattagaaaaacattaaggctaaactaaaagttatttcatagggactttcacaagtgctcatctgcatctgatttctcaactgcctcgttgagccaggttacaaaataatcagatgtgctgagtgtgatcagcatcgaatgagaggacacatgcctttcttacccaactgcagtcatccaggcaagagctttacttaagttgtcatgaagaggggagctgtgcacttggctctcaaaagcaaatttggtgtctttatcaagttattgatcatatacgtaccagtagtaggaggatgtcattactcatcttactgtgaaaactgacagaattacacgtgaaagcctttgcaaacctaaaggtgtttataacaatataagaaggtttgggcttttttttttttctcttagtatccataccaaacacttagagatagccatgaaatcaccagtaaatcccagttctgtgcttctcaatttttgctgcagattacaatcatctggggaactctttactatcctgatggcataccatactcgttatcaactaattcagtctctgatcctaggacccaggcatttttccttaaagctccccaggtgtgattccgaagaacaacagaatttgagaactattgctttaattgatcaggtttaaaaagccattgaattttcctaaaatattgattatcaggctttatcgtgcatcacagtaatctagaggacatgttaatacacagattgctgaactctaccctgagaatttctgatatagtagctctagagtggggcctgggaatttatatttctaacaagtgatgttgatgctgatgctgcttatccaagaccaccgtttgagaaccactatcctaaaataggaaatctgtcctacacagagggcttttgttgttgtttttaaaaattgaacatagtctccctaccaaaacatctgattttggatcaaaaagcactctgaatccgaagtacccctgtatgagagaaagagcaggcatcagagattccaaccatggctgaaggccccatttcaacaagagagtgaataggaataaagcacacagaatgtcttgacagactaccatgtgaggcttgagctaaagtgctgcatggcatgactctggtagttaaagccaactgaggggagacattgaaagctgataaatattatgataaatattatgatcatcccttacatcaattcccccaaagaaatgcagtgagtcagagtttaaaatattactctagaatgcagcctaaggcatcactgagcattaatactttatatacaatcctataaccaaaatatctgaatcttctgtaaaactgctgtgaagagatgatccatcttgaagtccttagtccttttcataaaaatatttccaataaatttctcataaaatgtagaacttctctcttaaaagaagaaaagtttgcatcttctagtaaagaggcaaagtttttcatcagtcagtaagaaatatgttatttttctctttgcccagtctgggattaatttaactctattgtattaattctagtgagattgttttctacccttcccctgtttgaattgagtcatattgtaaatgtatttactactttatgtcttttaccattatctaccccaagttctttgaatttgtgaatgaataaataaatgaagtaactatttttccccctccaccaccttctggcaaaattgattgcatttggggagcctaatctaaggagtattaattagactgacattcaagatttggtagtggggggtgattcatcaagatagtcaaaagggaagccccagaccctttttccccaatggaccagttgccattgaaagaaataaaaccagttaagagatttctgcactccagtcaagtgtaaagccaatagcattaaagcactgtagaaaaatttatggcactcgcttgctggagcacctcccactccccacagcgtagcacagagctatcagtagaaaacttccaattcctaatttcttgctggggagggaaagaaaagagtggaaggtatatccagtgtttttacttttgagggggaagtactacctaagggagtggtttccgttttgcctgaatctaagtgatgacagaaactgggctatgtgggaggccccctgagaacaaagtcttatcaacatggcttggtctggtatcaggctgtaccacagacactaggggaggtccagtaccaacagagggaaatttaatgcttcctgcagcactagaaagtccacagtacctgataaagacaccaagggaagctcctgagtagaaaccaacaaatcttcaattaggggattacatacaaaagcccagagaagatgcatcatcagaaaaggcttgagagatttgcggaatctctagctggactgattgctctcagactgcaaagactaggagaagtgtctgattttttaaatgccagaattccagcagaagataataaagcacacaaagaaaccagaagacatggcccaaccaaaggaacaaattatatctacagaaatcaaccctaaagaaacagaggtatatcaattaccaaagaattctaattattctcataaagacgctcaaggaattaagagacagtacagatagataactaaaggaaatcaggtaaatgatgcatgaacaaaatgagagtatcaacgagataaaagatgaaaatgagcccaaagaaattctggaggtgaagaatatagtaagtgaattcagaatatagtactcaatttactagagagattcaacaacaggcttgaccagacagaaaaaaataatcagcaattcaaagacagaacattagaaattattgaggcagaggagcaaaacggaaaaaataagaaaagtgaagaaagctgaagggtctatgggacatcatcaagtgcaacaatataagtgttatgtaatttgcagacaataaagagagaaaatggcagagagcctatctgaagaaaaaatggctgaaaacttcctgagtctgagcaaggaaatggattcacaaattttagaagctcaagaactgcagctaggatgaatccaaagagatctacactgagacacattataatcaaagtgtcaaaagtcagagaccaaaagaaaatcctgaaagcagcaagagaaaagcaacccatcacaaacaagtgtgcatctgtaagattatcaacagatttttcagcaggaactgcatgctagaagggagagagatgatctactcaaagtgctgaaagaaggagctgccaatcaagaatactatatccggtaaaactgtccttccaaaatgagggagaagtggagactttcccagataaacaaaagctgaatgagtttatcaccactaggtttaccctgcaagaaatgctgaagggagtccttcaagttgaaatgaaaggatgataaacaacacaaaactatatgaaaatttaaaactcctagataaaggtaaacatacagacaaatataaaatcctgtaatattgtaggtacaaaaatcacttttataaaaatctggtatagaatgttttaaaaagtataaaaggtaactataaatctatgttaataactgtacagtataaaaggaggtaatttgtgtcatcagtaacaaagtggggcagcaggatgtaaatagtttttatacatgattgaagttaaattgttgccagcttgaatagattattataactttaagatgtgctatataattacagtggtaaccacaaagataatatctatataatatacaagaagagaaatgagcagtgaatgaaaacatatcatttttaaaaataaaggaaacacaaggctgggtgcagtggctcacgcccgtaatcccagcactttgggaggctgagacaggcacatcacttgaggccaggagtttgagaccagcctggccaacatggtgaaaccccatgtctactaaaaatacaaagtttagctggatgtggtggcgcatgcctgtaatcccagctactcagcaggctgaggcaggagactcacttaaacccgagaggcggaggctgcagtgagccaagatcacaccactgcactccagcctggatgacagagtgagactctgtctcaaaaataaacaaattaaataaataaaaattaaaacaaataaaaatcgaggaataaaaatctcctcttttgaagacagaaagaggagaaagggtaaacacaaaagctacaagatacataaaacaaatgaacaaaatggcaattgtaagcccttccctatctctaattattttaaacataaattgattaaatgccccaattaaaagatatagcttgactgaatggattaaaaacaaacaggatctaactatatgctctctgtaagagacacactttagatctagggttacacgcaagctgaaaatgaaagaatagaggaaaataatccgtgcaaaccagaacctaaagagagcaagggtgaccgtattaatatcagacaaaataaactttaagacaaaaactgtcacaagagacaaagaaaaacattatataatgataaaaggactgattcatcacaaagatgtaactgttagaaatctgtatgcacctaatattagaacttccaagtgtatgaagcaaacattgacagaactgaagagagaaatagcagcacaatagtaggatactttgatactctattttcaatcatggatagaacagtcagacaaaagacaaataaggaagcagaggatgtgaacaaccctgtaggccagttggacctaacaagcatataaagaacactgctctctactacaacagaatatgaaatctactcatgcacacatggaacagtgtccaaaagagaccatatgttagggtacaaataagttttaacagatttaagaaaattgaaattatacgtaatatcctctcggactatgacggaatgaaactagaaattgatagcagaggaaaaacgggaaatccacaaatatgtaaaaattgaacaactcattcttaagcaatgaatgggtcaaagtagaagtcacaatgtaatttagaaaatatcaggagacaaatggaaatgaaaatacaacataccaaaacttacggatgcagcaaaagcagtaataagagggaggttaataatgatacatgcttacattaaaaaagaagaaatatctcaagtcaatgccctaacttcgcaccacaggcaactagaaaaagattttaaaaactgaaaaatcagtagaagtaatagaataatatatattagagcagagataaaggaaatatagaatagaaaaatactaggaaaaaaatcagtgtaaacaagagttgatttttaaaaagatcaaccaaattgacaaacccgtagtagactgagaaaagagtgtactcaaataagtaaaatcagaaattagagacatgaaacagatgattcagaaataaaaagagtataaagaccactataaataattattcactgaaaaattggataacctggaagaagtagataaattgctagaaacatacaactgcttaagactgagtcttgaaggaatagaaatgtgaatagacttagaactagcaaggagattgaagtagtaatttaaacttcccaataaagaaaatccctggaccaaatgcctcagtggagaattctaccaaatacttaaagaagaattaacaccagttttccccaaacccttccaaagaattaaagaagtgggaccacatttaaactcattctgtaagcgcagctttatgttaaaaccaaaaacaaacaaggacagaagaaaactacagaccataaccctgatgaacattgatctagaaattgtcaacaaaatactagcatactcaactcagcagtacattaaaaggattatacacaatgtcaaattggaattatacctgaaatgcaaagatggctcaacatacaataatcagttaatataatatactgcagaatgaaggaccagaaccacgtgatcgttccaattgatgaagaaaaagcttttgacaaaattcaataccatgtcttttttgtttgtttgttttttcactctgtcgcccaggctggagtgcagtgttgtgatcttggctcactgcaacctccacctcccgggttcaagcgtatctcccacctgagcctcccaagtagctgggattacagacgcatgccaacatggctggctaatttttgtatttttagtagagacggggattcaccatgttggccaggctggtctcaaactcctgacctcaagtgatcctcctgccttggcctcccaaagtgctgggattactggcatgagccactgtgcctgccctaattcaataccttttcatgacaaaaacactcaacaaagtagagaagcaaactacctcaacctaatgaaagccttatatgaaaaattttacttctttcctttccaatttggatggcttttatttatttacttacttattctttgtctaattgctctgcctaggacttaatactaggttaaatagaagtgctgagagtgggcatccttgctttgtttctgatcttagagaaaaagctttcaatttttcactgctaagcatgatgttactcatccactttacagtcagaaaattaaaaatggaattaccatataatctggcaatcctaacatttggtatatattcaaaataactgaaaacagcatcctgaagagagatttgcacacctatattaattgcagtattattcacaatagtcaggaggtggaagcaacctaaatgtccatggatagttgaaaggatagaggaaatgtgtttaagtacatacaatggactattatttctgttatgtattacaacatgaatgaaccttgaggacattatgctaatgaaacgagccagtcacaaaaagcaaatacttcatgattccactttgtgagatgtctaacatagtcaaactcatagaaacagaaagtagtgttgttaccaggggctgggagagaggaggaggaaatggggagttgggtaatgggtatcaacatttagtgttgcaaaacgaaaacattctcgcaatgagttgcacaaaagtgtgcatatagttaatactactgtactgtacatgtaaacattgtcaagatggtaaattttatgttatgtactttttttttctttttctttttttcaatttttttagtatttattgatcattcttgggtgtttctccgagagggggatttggcagggtcataggacaatagtggagggaaggtcagcagataaacaagtgaacaagggtctctggttttcctaggcagagggccctgcggccttccgcagtgtttgtgtccctgggtacttgagattagggagtggtgatgactgttaaggagcatgctgccttcaagcatctgtttaacaaagcacatcttgcaccgcccttaatccatttaaccctgagtggacacaacacatgtttcagagagcacggggttgggggtaaggccatagattaacagcatcccaaggcagaagaatttttcttagtacagaacaaaatggagtctcccatgtctacttctttctacacagacacagcaacaatctgatttctctttcctttccccacacttcccccccttccactcgacaaaaccgccatcgtcatcatggcccgttctcaatgagctgttgggtacacctcccagacggggtggcggccgggcagaggggctcctcacttcccagtaggggcggccgggcagaggggccccccacctcccagacggggccgccgggtggagacgctcctcagttcccagacggggcagccaggcagaggtggcgctagacgtctaggtggcacttcctagacggggtggcggccgggcagaggctgcagtctcggcactttgggaggccaaggcaggcggctgggaggtggaggttgcagcgagccgagatcacgccactgcactccagcctgggcaccattgagcactgagtgaaccagactccgtctgccatcccggcacctcgggaggccgaggctggcggatcactcgcggttaggagctggagaccagcccggccaacacggcgaaaccccgtctccaccaaaaaatataaaaaccagtcaggcgtggcggcgcgcgcctgcaatcgcaggcagtcggcaggctgaggcaggagaatcaggcagggaggtcgcagtgagccgagatggcagcagcacagtccagcttcggcatcagagggagaccgtggaaagcgggaggcggagacgaggcagagggggagatggtggaaagcggaatagggagaggaagagggagacggagacggagaggtgtactttttaccacaatttaaaaaatagaagatttagcagtatttttcaaacttgaagactcatatgtattacttgggaattttgttaagtttagattccaatttcaggtctgaggtagggcctggaattctgcatttctaacaaacttcaaggtgatgccagtgcttctgctctagggatcacattttcagtggcaaaaagttgtgaaatcatagatctcttctctgtcttgtagtggatggagttccggagggtgtacatttaacaagcttctggtgatttttatggtcaattaaattgagtttatttgaggtgccacagatctgtaatctgctttctagatccctttcttacccattcttaagccatcacagcagagtacctttctaacttataagattgtgtagaggttggaaggaggacaggactgttctgttggtataatgaccctgtgtccagttaatccatgcttccattgctacattatccaagagtgcaacatgacccaacaaaacctctatcagtcatgtgaggcattttttttttaacagaagaagagcattggcaccaacaatattccatctcttctttttccagcatgagaagaccatggttcttctagactcctaaagaaagtcatttgtacttagtgtaaggcgtgttgcttttggtaaagtcttttgaatgtgatgaaaatgaacatagcacaaaggcaaaatatatgctctcattgcctgcaaaactgtttctggtgctttattgaaagagcatgataagcaagatatcagtcactgccgcattgcataaacatagctcttctacattgtaatatggttctggtgagcctgcatgtctagaatagagcctgtatcactgaagtgcatgaaactgctgtgataacttgtctcacaaagcctcagggaacacattatttgagcaagtaaactcaaggtgaagttcttaccttctcagtcctgggtcagctgttggacatactggggaggaaagaggagaccatgtgcttctgccgaacaagacccaaatctggggaaagctgaacttccagggtgcacttgccctgttaccttctcctaagtacatgttgtgggaaaagtagggaaaggcggttagctgctagagctagctcagcagcaggagctcattctatgtatctcttctcaacccagcgttcagtgacttcatgttgatagcttgaaattggccaaggtaggaatatttacaccacagaaattggcaaggactacaaaccaaattctttggtgttttattttattgttttgttttatttagagagccacttgtaaaacatttactatcacaccagttcagatgatttagtagtataaacagcccatgtggtatttcttggataatttgtttcattagactgaggtacaactccaaagaggatgtcatgtcctgtacacaggactggaagttcacgaagccattcataaccctatatgaaggggagaaagagatgtagtgttcaggcaaagcctcatgagacgggaatttcctgttttgaactgaatccctgatttctttcctgcaacatacattcattcatcaaatattgattatcaacttttttataatacacaaaagggaaagaggctcttacttgaattatgccagaagtcagacaaaagaaagattgttgctttttggctggtcatggtggcttacgcctataatcccagcactttgggaggccaaggcagtaagatgacttgaagtcaggagttcaagaccagcctggccaagatggtgaaaccccatctctactaaaaatacaaaaaaaaaaaaaattgccaggtgtggtggcacacatctgtagtcccagctactcaggaggctgaggcaggagaatcacttgaacccagaaggcggaggctgcagtgagccaagattgcaccactgcactccagcctgggtgacagagcaagactctgtctcagaaaaaaaaaaaaaaaaaaaaaaaaccagatcgttgctttttaaaaattgacttaattcttcaataggttcattgattaaatatcaactttgtatcaagcaccgtgccaggcccaagggatatacagatccaggatacatattcttgccttcaaggaactgatgttctaataatagctaataacaagagctactatttcctagctactgaaattctagggttctcactatcatagtctaatgactctcttctgttcatttagcagacttcgcatactgtacactacctgcataaccaaggacttgagtttgtataagagtttaagacactgacatgtaaatgaaatatcaccaatttggactgatataagaaagtcgatgtgattacagagtgtttaaaatgcagactgtcttattatctttatatggataggatgggtcaaaggaggttaacaagaatttagcagctgaagccctacttaaagcattatataagaattaattttaatcaacatgttgattatataagaaataatgttctaaaatgtctttaaaatatttttctgggaataagagaaaacctccacctatgtttatgtaactgatttttgagttttcaagtcttttataaaaaaaaataaaaggccatacctaatcctacttgttggcagagaaagatgagagatcttgaaatggctcccgtgctcaaagtatttgtcagttttcatagagcccgaagtgccgatattgaagatgtatttcttatccataccagcatgtaatactcagcaggaaaaaggaacaaaaactccaaaaggtcacatactgtatgattacacaccacacacacacagactctctctcacacacatatgtatctaaaacattctcagaatgactaaactatagtaatgggaagaggtcagtggtttccaggagttacagaggggaggtagaaggaggctggatatgactgtgaaggggaagcaagaggaagatccttgtgacaatagaatagttccctatctcagtttccatggtgcttttgcccagtctacatgtgtgatacatacacattataccaagtatcagtttctttgtttttgtatttaactgtatctacataagatgtaaccattgggggagacggggtgaaggatgcacaggacctttctgtattatatttggtactttctgtgggtctataattatttcaaaataaacattttctgttttcaaacaatgatgtgtttctcggactctaagaaaattttcagcagaagaaaagtccgtgataatggtgactggggtagtgcagtagtggaaatagcagtggagaggggacgtatgaagttcttaatctggatcaaatactgtgctaagtactttatgttcaatacatgtattattttatttaatcctcaaaataatctcatgattgtaaaattcttttgtttcataataacgcccaaaggaataggagtttttaaacccaagagctgcccgtggaagaagcattattagagccatcaggaaacagggcattcagtgaattagaccgaaacaatagaaggatggatattaggaacactagaaggggcacatcatgctaacatcaaaatggaaaaatcatctacttcagagttgtgttgagagtctccttgtgaatatcattcataataagagagcactgacttgttttttaaaagacagggtctcaccgtcaccaaagctgcagtgtagtggtgtgagcctagctcactgcagccttgaactcctgagttcaagtgatcttctcacctcagctttccaagaagcaagggctacaggcattcaccactacacctggctaatgttttattttttatagagactgagtctcactgtgtcaccgaggctggtcttgaactcctggtttcgagtgatcctcccgccttggcctcccaaagtgctgggattacaggcgtgagccaacacacctgacctcagagaaggctgatttttgaatcagccattctaaaacagtggacctagaaagaagaaatcttctaccagtagccttctttctagatagcaatccaacaggccaaaagaaatttggggtctcataatctgataccaatattttctcctcagtagtgaaaagatttgaattaatgcatttactctaagcttgtttttagggaatgatgaggtaatagttaaagaaagtagacaacggttaaagtaataagaaatgctgaacttccaaaaaagctggccttaatattctccatcaactggcagtgttcccagtgatgcttctatcacagactgtgatagaactggcattacacaataatcctttcttcttcaataatgtagtaagacatcacatccatatatttcccaaataggactgccactgcatatctagttaaggagctatcattctactgtttctcttgagaaatgacactaaagcaaaaaacttttaagtttttgaggggttctattggccacttaaaatacccttgatatatgaccaaaattcatttaactaactaaaaacaaatagttgtgaattacatagagggcttctctcagccagatgcttctcatagataatctaataaagatcattgaaaaataataaaaagttgcatttctcacatggaggaggacccataatacagttcattctaatactgagggagtggtgccctctagcagtgcatgtgagaaatattatcatttaagtatattaaatacagcaaataaggagctcccagtatctcagctactctcagacataaggggcaatttgacagttctgagctactagaaactactgaagtttcacttccatgtgcactaattttttaagtgccagcgaaggttagattctaatagtgcccttctggggatttaccaataacttttaaaacctcattacctgtgaatgtcaaatagaacaggtccctttcacttttccttcaaacctcccctaggtcagtgtttgaggatgagaataaagggtacaaataggaaaaaggatcatcctacaagctgaacagcatctctggtgcaaaagatgctcacaaaatgggagaatgttaagaaatccattaatagctcaagtattcaaaaactgatggagttctgacaattttcccttaaaagtaccacagtttatggttacaactgataaatttgcagggttagataacttcagaagctaattaagtaaattgagttaacaaaagaaaagaacttgattttttttttttttttttttttgagacggagtctagctctgtcccccaggctggagtgcagtggcacgatcttggctcactgcaatctccacctcccaggttaaagcgcttcttatgcctcagcctccccagtagttggattacagaggtgcaacaccacgcccagctaattttgtatttttagtagagacggggttttgccatgttggccaggctggtctcgaactcctggcctcatgtgatctgcccacctcagcctcccaaagtgctgggattacagacatgagccatcatgcccggccttgaatttttaattccattttaattagtgaaagatgttccagccagtcttatctcgataagatatccaaaagattatatgcacaccaatagtacattacaaatgcttttgaaactgaaaggtgtgttttctggtttctgtgtgtctgatatgctatttcaaatcctgtaaaagcaaaatgtagttttttgacaaatatgcccatgtgttgtgcacagtttgatttatgtaaactcatttcaaatgctactgcagaatttctcctgaatggatgaaaaatgtccgcctaaagtgataaaattatatgtgtagaaagatacagttttaagaagggatttttatatgatacagatttgtaactctatttcacaaaatatcatttaaaaaaaaacttcaagaatacctgactttttttttttacatttttctgtcagttcaggggtttgcattgagtttgctctgctgaaacacttttctgtgacttagcttatatgggattggtaagtaggggaatgatgtcagtataacatagaccctggatttgttcaggtattttactaagtagcagcaaccaaacacaaagcctacgaacacagattaacacagctagccaagggaaaatacctactgcacatgattcccattcatgccacattcttcctgttggtgcagtgtggccacgtactccaacatgggagtgcttattgcgtaattctcaatctttctgcaatttgcacttatttcatagcttagcaatctcaactcttccttctttcttccatcaagctaccttctcatgcatgtgcacacacacatacactgtattttttgtagtagttattatgaatttaacttatctttttaatcatgtttatatttaattatgtttgataattactaggatggttattgtttttgtagtgttctcgttacataaatattgagtaggtgtcctgaccctatctttttcataaaccctacaatttttattgcatgattttgcagaccatagaagaaatgcgtttatctcattaaagcaaaaacatctgtacatctgtacttgcactctacttattaattgcacttattatcattgaattactcccagaattatagacttccctcataaatctgaggtaaacagattgagatatcaattgcctactagattcatttttaaaattttaccttcgcatgagaataccagccccaggtgtacattgcatggccctattaaaaagtgacctctccatctttatttgtttctaggcagttaccgaaagtatttccacaacaaaagaatgtaatcaagatttgacttgcttccactgaagcttactttcatttttaaacatcattagcctatgatttaggaacttttaagaaattggcccccattaccccccaagcccccgcattcacataacacacacctcaagttctcctttaagtaatttgtgatttatatttcaattttacattcaacatggtcttaaatattaaattccaccaggtcaaactgcaatgagtcaggcttttaaaatatgataaaattaagattccaagaaatgaatccttccattccaaaatctcttcttgcacattaattcaattaactcagaagaaaatagatattttccaggaaaaatgtcttttattttacttttgtgcgaatacaaatatgtatcttttgttttaggaaagaaataattctctgatagtatttccataggactatgttactggtgttagcatgagtgaattttttagaacgctagtggtgagcatataatagagctatctcaacacctacactccaagaacaagtcacagcttctcctaaatgagccaagcattgcattgggcacttgcagtgaaaagctaaacaaaaccctgtgtttaagaagcttacggagagtgacaatagagacagttcagcatgttctctaatagagatatatatgaagagtgctatgggacaaagcagaggtggcgaccatatcagagagcaaatgctttaacctacacaattaaaaaaaaaaatcttatggcgttcctaattttgtttctttccctttcaattttctgaaattttaaaatgtttgttcacttgaacatacaataaattttctttaaaagagtccctcaacagggagatgagaatattctgtgtcttgatcttcatggtggtgtataccaaattcaccaaactgtacacacacaaatgtaccttttaccaaatgcaaattatacctcaaagtttactaaatccatcaaaacatacagtgctacatactttaaaaaaattagcttcctccctttgatgaccaaggtagcaataagtgtattagagaaagaaaaagatgctgggtgtggtggctcatgcctgtaatccccgcactttgggaggctgaggcgggcggatcacgaggtcaagagctcgagaccatcctggccaacatggtgaaacgccatcactactaaaatacaaaaattacctgggcgtggtcatgcgtgcctgtagtcccagctactagggaggctgaggcaggagagtcacttgaacccgggaggcggaggttgcagtgagccaagattgcaccactgcactggcaacagagcaagactctgtctcaaaaaagaaagaaagaaaaagactaaggaattatctcatggaaggctgtcttgcataataattattttttgtactgtctttcagctgtaggtccagatttttcaagaacactcttgaaaagagtaactcttgtcaaagtgggaggtgaagttgtcattgagtgtaagccaaaagcgtctccaaaacctgtttacacctggaagaaaggaagggatatattaaaagaaaatgaaaggtactgtcttgaattattttcaatatttggttaacctgtaaaaatgtgttggtctgttattaataattctaaggggaaggtggggtgactatctgctgttcctgaactaagtgttaaaaaaagaacagaagctttggaaggatgagtggtaagttattgatctttatagtccttctggatttgggaattctacaaagcactccgtgcagagatagatcacatgatccccgctgaagactgccagagctgcctgaagatgaacagttagaaacatcctccttaatttaagcctgaaatttttgtagatttccccacctttccccatcctaagtcctttggtatatgtaaataagcccatgtcttatttgctatgacaacccttcaattatttggcagtggctattatgtctcctgttagtttctccttttttgaggctgtctcaaaactcattcaaaactcattcttttcaaaactcatacttcaaacagcagagtgttatgctttttatttcaactacatatttttgagaaaacaggttttttttctaatatctaaactcttcatctgtatatttcttatacatgaattacatttagaatgcatgtagtgtatacaatgcaaatatataggagttatttgaggttttacattagcttgcacgaaatggcaggtgtctctaagaccttttcttggctgtcacccctgtaaaatatcccctacctttttctataatctacttaatctgttgcaaaatggtaattatgcgtgaatctgtttgtcacctataagacaggatttgccagctgtatatataatgattttaattaatgctaaaggtcaggtactcaaggatgcaagaaggaagcctataaaaatgtgtacgtatctaccctttacacctgtacacctttggatttgcatatacatattagacctgatgatgatggtgttgtccattttaatgtaaacctgatatggtttataaatggtgtattcatactttttttaacacttgctatggactaaggagtaacaaatgtattaaatttgtggtatacatccctttctgatttctggtgtatcaagaaagcagtgtagttcattgaatgttgacatggcattcaaatttgtagccaaacctgaaaatcaatagcataattgcttattttgcagtcatcaacatgagattcattttctgttttatttacttcagtgtttcttaaaatgtggcacgtgagattacttttaatagctatgtacttacttttaatatagttgaaatataactagtatgtaccacatgtatttctcagaataaggctacattttaaaagttttaattttaaaatgacactaagaaaataataatatgggtattagacatgtcaaaaatcatgaatgaataaagttataataacactgtaggtcaatcaggagaagctaagctatgctactgtaacaagcaaccctgagttctggcttataacaacaaaaggcaatttctcttttgcacctagtgtacatcaggggtttggtagtggctctgctcctctctaaggccagcctggtggaccaagatgctctggacgttgccattgcagaaggaaaagagccaaacatgcatgggttcttaaagcctctacttagaagtgcaacacttgcactttcactcacatttcattggccaaaacaggtcacatgttcctgcaactcagcagggaaatataatcttgctatgtgcctggaagaaaagagacaacctaatattttgaacagtattaatgactgcttacaactgctacagcttaaccattgttacaagctaattaaattacctttggggaaatagtatgccagtatcaagaattctatatgatatgtgaatttaattgattgtttccaccacttgacttaccacaaagcttgtctttatccagatttcattctatctattcctgacttgactaataaggtccaaatatgcttcaacatttattttgcactaaaatatatatttaaactgaggaaactccccatcattacctaattcctgctatttatcgcctccaccttctctgtcagcaggctagtcccaaactatcaatattagcacttattctccacatgagtgctgtgttctcacagttctgatcctcgttcccacctcactcagaatgtattaaccagatatgatgattttgttaatgtaaatgcattaaaaaactggccaggtgtagtatataggggaatgctggggacttcagtgtttgccccatccaagggagacacctgccactcagccatatggagacacaggtcaggtgcctgctcatcttcttgttcttcaagagaaactagaaatctagacttttgtttgagcttccattttttaaatgtcagcaactaatttttattttgatgatgtacaatataaactgtgtgcttatagaccaagtttacttcatgagccacgggtttttaacttctgagaacatgaagtggaacatttcatagtttctgaaatgggtgaacaataagaaagattttatgattgttttctcattggcagagaagagattctgccatttttctcatttctttctgatagagaagagggaaaattaagtggatgagtgagaaaaagcaattgtagatgaaactgatgagtaaaaaattttagaacccctattttgggaaaggattgacctggtagaccaacatgaagtgcaaaattctttgactacacagctttgagtaataatttctaatgcactgcctcattagccttaattctcttttcagatgtagaatcttaggaaacaaaaggcaagtctttaacctttgattaaaaatattattaatcccttaagtaaaaaatactggcataacacagtgaaacaacactttatgatcaagccccttttattaatgttctgcctagattctgtgttttgaaagactttgctaaactcttacttattgacatttaatttcaattttaattaatcaactgcctacaaatgagtttacagtagtggtattagaagcaatattttaaaaattaaaaaggttttgtctcatctaaccatgtggtgatattgtagttagctaagtggatatagattcagaaacactggtttaacattaacatgttcgttatcttaaaaatatgtttaaaatatgttattgttttggcttcccattcttttggaaatatacagcatattcacactagccttatctatgttaatccaagcatctaaatgaaagattgaaaagtcaagtaatttcatagcattcttcttgggtaagcagaatatccataaacataaaacatttcttattgtcttgtgtgtgtctccagcaatcagtgtaggcaatatcaggcatttaaaacagggaagacctgtcacacagctcaagagctttagtcctcaggagaggtctctagtcaccataaaggcagttggaatcatttggatgaattgaggaattaagcctactaactgaataaggttgattattttatttactgttagtttttagacagaaggtactttgaggcaggtaagactgaagttgacctattaaaaacaaaaacattaaaatacagaaatagcagaatcattaataaaaatcctagaatcctaggattataaggagctatacaacaattgtatcaacccagggtggatgcttttggttacaagtaagagaaacccaactcaaaaggacaaacgagaattcattggctcatgtatttgagaagatccaggatggattgcaactgcaggtatgacagggcttaggtgctcacacagtatcatcaggactctgtctcgctctcttcctgtctcacctgcacctttggctgttttggcttcttttccaacaggctctcctctcctgctagtaggatgactactggagccatgtactcaccctcttttccaatgtatcgcaatgtccactgatcaggcagacgtgagtcatgtgcttatcctaagaggcacatggggaagcccatctcaaaccacatggactgagaatgggacaggggttttcccaaagaaatcgagctgctatcaccagaagaagagggaatggatgctgcgcagaggctgatgccaaactcccaccataattacagagcccatcttccatgccagggcagggatccccacaatggctgggcccacatccttccctggttactaataatgatggagaccttactaattgttagattatgtccttgcaacttccactcatttttggtttcactttgtggaattttactgacaaatcagattgttctccaccacccctcccttccctttctatactgggaggctaccctatgttctctttcaattcttttctaagcccagatgtcccccttgtatctgattttcttcagacagcgttgtttggcatcctctcactgttttggtcatttccaagcggttttaataagggaaaaagtagctttatttatctccacagaaaaggatgatgattattattgttatactagagagaaaaaatgaccttcagcgagtttggattagtaaggcaagcaagtgaatgatataacatagaaagaccactccctgccaatgtttatttttaaaaattaatgtggtgcttagacaagaaagtttagttgtctggaaaaatcactgagacaaaatattttacttttcaccgaagccaaataaattaataaactgtcactctcattaatgttgagtaaataaagtcttcttattcttatgcttaagggtttccccccacccttttaaatattagactaatacattatgtcaagcaaatggataataagcaggtataggtacgccactgaatttttccaaaaagaatctcacacctacagtctgcatgtcgcaggcttgggtttagaacagcagcatgactctgttttgtgaatctagccaattccagtttcattccatggatgcagcactcactgggtatttacctttgcttagcactagagagagagaaaaaaaaggagacatgaacctagctagccctcacggtgctcatagactagcgcagaggcccagtagcacaatatcaatataaatttttcaacaatcctgaggcatatgttataaaggtgatgtattgagaaggactactggaaaatgtagggcagcgatagattgtggaggccttgtattttatgtctgtggagtttagacttgaatcagaagaccatggacagaattgaaggattttatgcaagggagtgtgcagtcatatgcatgctacagaaaaattactgtgcctgcaacatgcagaaggaatcagggtagggcaaggttgaggatgcagagagggcaattccaggtagcagtctaggaagaaaatcacaacacgtggatcacatcagtctcctgagagtgaaagagagaagggtgatatacggactattaaagggtagaactgaaaacacttaatgacctagtaagtagaaggattgaaaaaaggaggaggaaaaagaggaaatgcctcctaggatcccatctttaggaactgacgaatggcagttcctaataccacttgccgcagtagtaaacagagaaggagcaagactgagagggggcaaataaagaggttactgttagcatgttgaatgtgaggtgcctgcaagtggtgacgtcattcaaacggggattcccattcaagtgtcacctgctcagagacacttttcccagtaacatacttaaaatggtaaaaccctcaccttcttttcctaatttatatattttatagtatttgtcaccatcccacatactatgtattaacttttaattgtttatttatttattattttttagagacagagtcttgctccattgcccaggctggacagcagtggtgagattatagctcactgcagccttgaactcctgggcaaaagcgatcctcccacctcagccccctgagaagctgtgatcacaggcacatgccaccatgcctagctaatttgttttgttttgtttcgttttgttgcttgtagagacagaggcttgttatattattgcccaggctggtcttgaattcctggccttaagcaaacctcctgtctcagcctcccaaagtgctaggattacaggcagaagccaccacaccttgcccacattttaaccttatcatcgatcttctccaccctccacccattggatcgtaaattccatgagaatagaaatgtgtgctgcatgtgcgtgcatgtgtgtgtgtggccggggtggggggtgggagtttggcttaaacagtacaaatttaggccgggcgcagtggctcacgcctgtcatcccagcactttgggacgtcgaggcaggcggatcacgaggtcaggagatcgagaccatcctggctaacacggtgaaaccctctctttactaaaaatacaaaaaaattagccgggcgtggtggtgggcgcctgtagtcccagctactcgggaggctgaggcaggagaatggcgtgaacccagaaggcggagcttgcagtgagccgagattgcaccactgcactccagcctgagtgacagagcgagactccgtctcaaaaaataaataaaaaataaaaaataagtacaaattgagattcttatagttctggagataaaaattctgatatgggcctcattggtctaaaatcaaggcttcagcagagatacactcattctggaggctctaggggagaatctgtttccagcttctacaggtcacctccattccttggctcgtggtcccttcgctccatcttcagagcttaatgaaaaagtgagggaggcaagtcttaatcggtagaggtttatttcgccagggttgaggacatggctgggaaatacatacgtcactggagcatctgttactggtgctcttccaaaagggggtttgaggatttttcagtatttaaaagggaaagagcaagcaagagagaaaaaaaaggagggagggtggacaaagatgcagatgcttacagtctttatttatttatttatttatttatttatttatttatttagagacggagtctcgctctgtcgcccaggctggagggcagtggcgcgatctcggctccctgcgagctccgcctcccgggttcacatcattctcttgcctcagcctcccgagtagctgggactacaggcacccaccactatgcccggctaattttttgtatttttagtagagacgaagtttcaccgtgttagccaggatggtctcgatctcctgacctcgtgatccgcccgcctcggcctcccaaagtgctgggattacaggtgtgagccaccgcgcccggcccagatggttacatttttatgaggctgtgatcggcctcaggaaatgtacattttacgtgtgaaaagagggcatcaaggaaaaagtcagttatgcattcgtcgcagggtcagccaagggataatttctggttttgtccttttcctctccgtgggaagataagctggtaattgacgttgtcagggtgagattcaacggaatttggttttagggctagtttatacaggggatatgtatcctgaaagatttaggggctcacaaggaatttcatttgtgacgcaggccatctggggagatacgtggccttctgtcattgtgggaacctggcttatgggtgaggctgtgatacagggttgtgaaattacagctatcggtctgggaacaaaaggaaagcagtgttgcgtgactcagttcccaagcttaactttttctttggcatagtgagtttggagtcccaagattctattttctttcacgctagtaaaggcaagttcttcccccatcccaccactctgacctctcttctgcctccttcttccattttgaaaggccttttctattgggctttctgtatatgttttattccgttctttaacactacaacactgcctggcatagcataagtgctatgtgagtgtccaataggaaactggaagtatagatctgagttctggaatagagacagagatacagacatcagtagataagaagccatggagtgcattggagtgcatatgttcatccagagagagttctacagaatgagaacatctatggctcaaaggaaggtaccctgaggaacagacacattcagagaatgagcggaagccacgcctgctgggaggtttgaaggagactcaaagaggtgggagaacatctaggagaaagtaacaaacagaagccaagggagaagaaaggtgcaacaaggagtaagcgcttggtgcttccaagaccctcaaaaaaataatggtgcaagcatgactgctggatttaggaaccttaacgttaccttgggcagagtacttttaggccactgtggaccagttttgaagacacaataaaattgtataaacatccatattcttaggcatgtcttgccaaaccgaaatacatgtttaggtctgcctgacccctgcagtgtaatcagatcaagtctagcattctgtgaaaatatccaactgaaataagaatgaaattcatgctcatgtgtcttgtctatagacactggtatctgcctccaaagtgaaattggatcataaccctaatttgcctctcttcccaaaggcttttggaagagttgaaattcatgtaagacatggaaggaaatcccagtgcagggctgcacaactctgtgttgcacacaaggtgtgaaacccaggtccaaagacgctggcagtctgggaggcaaagcaaatgtgatggcaggtatttgcccagaaggccgatggaatcctggtgtggaaagtaaagtttattgcttcaggcattctgtctctgttctggaggcagagtgtctatatatgtgctcttaatgagaaacctgccctcaggatatctcttacagttgctgcagagctataaagctctgttattaggaattctgccctggggaacaattatgttattgcaataattagaggcagttcatctccataataatggaaatcctgccttgtaggcaaaacaacatcaaagcaacaggagcgtcattgctctagttagaatctgctgccctgcttattggtagtactatcattttaattttgcacatgcagttacgaaagagagcttataccgctcttcaaattcagacctagaacttcttgccgttacttcagtttgtctctcctagagccatggataaaatagttacggcgttgagctctcctgaagtgcagttgcaaaagtgtttagggagattggtgttttaaaaatgtttgtcagaatccacaggcccagtcctctgggagaccccataaacttaccctcagccaaagccttttctatgtgggtatagtatggcatgttattttatggccagggttaaaatgatgactaaatccggtgactacctgagatgggtctgaccctttgctctagtcatgtggcatagtaataccagaagacatacatgtggttatataactcaagacatatatatggaatttgtatatgaagctgctttttaaaaagtgtccaatctaaaggtaacatttgattttcaaaaaaaaatcttttgaagtgtctcacatattaatcccttccttgcaagtaagtcctttgccactcccctggttttcaggccttattgtctcttgtgtgaattttgcaatgattcaaccaacctcttaaatgatttcattggaaccagccctcacccaaatcttctacaagatgaaacttaccacaataaacctctgagaaattcaattgaatgaatatctgtcacgtatctccctggtacaagatgtatttgagattatgaacataacctaatttaaatcaaggttctacatgtgtcacggaaaagggacgaaacagtttcttccatgatttaccagagacttttttttatcttatcatagttataaacttcatatttacagctattggttatttaattaatgttcattttccctaagaggctgaaagggccatgctgaaaagtgccatttgtgttggagcatacaggttccccagttccttgtgctatacctagagtagaatagacactaatgttcttgtatgaaatgaatgaaccaacccaaatcgtctgattcttggaggggattgaggagaaggtggtggtagtatatttaggtgcaaggagcagcgggaaagaaatgtatttgaaaggaaagtagagtgaaaggtttgagcaggaggagataaaactgggacatctctcagaatccagttgagaaaagcattccatggcaagctaagaagctggcatttcactgggaaacagagtgaagtaatgattttgtcttggggcttcacacttccttttaagttatctcctgtcctccatcggttgagttcagtgtttgtactcaggtagtgtctgccgtgacttaccatgcacccacctgggaaagcatttcaacttcctaaggcagtgtttctccattcctagagcaaagatccagtggttgttcccaaatttaggtctgcagctcagtgccaggctgactgcagcaaaatcaactgagatgtgttttagaaagcagagtcccactctccatcttcaaagatgctttctcgggaattctgagatggggcccaggaatcagaatacttgtttcccataggattttaatgcacactcaggtatgacaacgtagcagtggcttcccattgacttcaggatagacactaagtcttatgagatgaccagtaaggctctatatgctactcaggctcctgcctgctgtctaccagctgtctcacttcactcacctttaccctcagtttttgagccacacggaccttctctcttttcttcaaatggcttcttcttcctcttgctgcaaagcctgagaacgtgctgttctccttccctgaaatgctcttatccaggccttgaaaaactaagtccacaggccacatccaaccctccacctgtgtttgtacagttggcaagctgagaatggttttacatttttaaatggtaggaaataaatcaaaagaaaaatctcattttgtgacacgtaaaaattatgccgatgtcaaatttcagtgcccacaaataaagttttactggacaggacacagccatactcattcattcacaaatggcctgtggctggcggcttttacactgcaagggcaagattgactaagtgggactgagcctacccagatcaaaaagcctgaaatatttactctctggctctttacagaaaaagtttgccaaactctgatctaactcatggtacatttctggaaatgtggggtattaaaacatcttcatagtaacatgatcttcccccaccttgggttttttgtttgtttttggtttgctgtgccttttatttgttctttgtgacttacacttttgattaaattgtcacttccagcatgtccgtcttatgcaaagcaaaggggaagtgaatttggtgggaggtccgaattatctcactttgctctctagagcagtacctcccaacttttgccaggaagaacttcttttcatgcccccaaaatctgaactccctggagaaatcagagcccaagggagctttaaatgtgaagacacagagggtgagggatggtggcagtggagagaaaagtagatacctggtcatcttccccatatttctgaacaaccagtaaaaaaatgaagtaatgggaaatctccatccttggttgaggatccatggttttacgtggactattttatacaggtgctttaagtttatgctgataaatatttatgaatggtctagttccgttggggaaggaaagagaagacagcaatcacaggacttggtttctagagttttataaaattcagctactgtgaccatgtatacacacatcaaacaatttagaaaccaccagtgaagcacaaattaacataatatagtccaaacagaatccacagcagtgcttagggaacagactgggaagagactctcagtcaggcagagtctgccaaaatcgacttccaacaggaagtgagtttaagcctttgtgaaagaaaatgctccacagagagaggaagagagggaagggagaagtctccatgctggagcccatgtacgtgcagcaagtcatgtacaagaaatgaggggaagagagggactcagccagggggaggagttgccatctgtagcatttagatggaagaggtggaaggacaaacatcaacaggaagaagctacaggtttaactagagttgattaacactgtaaaataatatgaatgaatataaaataatagtgccagaaacacggtgagtcagcttaactgtgaagaagtttgggaatctctagccattaagtagaaatgagactttgatctctcgttatatcactaatgtatttttgaatacatttgaggctttggggatccttggggattcaggttacttattactttggctctagtcctgtatttcatggttatcttgtggccatttttatctctgtaaaaaaaatgagcattttcaaccccccatctgtcaataataatagtaacacccagcgcttgttttttttttagtctttactatgccctctgcttaatttcttttaatcctcgtaaaaatgttatgggatcagtcctattattgggactccatctttcagataaggaaaccaaggctggaagaaagcaatttatttaccttacttaaggttgcaaagcttgataatgttaaatctggaattcaaatctaggtctcactcattgcatctatgtctaccaggtttgcctgaggaaggaacaagcactagatgcttctttctaagctttaaaagggagataaagctttcgttacctccctggcataggactggcatagcagcttttcctgttactcatttcatattttcagtaataaactggcagctttcagatccatagctttatcatttcctgagagggagagaggtaggatggtctgatttcagggctgggttagaaccatgtaaaccctttggagaagaggtaaattaagtccttgaactacctcagccgtgcctttgttcagagaaaatagctgtgtatcatcaagtggagttaagtgatcatgaaaatattcaaaccaaagtggcatgtcattaagagcaattagaactgaagtgatgtgactggatattaaaaccagacaggcagtgctttgtgccttctcagtagagacaaggcagatgatttgggttcctcctaactttgtcatctctagaaataaaatctgctagacttcttagatgtattgatgccatgtaaatattgaaggtctgggatcatatactaagtttgacccctatatttccattatagagttttctcctcatatttcagtcacagatatgccagagttaattagatctctactagtaaatatccatcatgatgtttctaaatcccttttgccaaatgatctaattagagcaacacttggctttctatataattacaacatatggcacctagagggtacatatagtagaattataggttgcctgatgagaaatccaggtggtgggtaaaagactccattaaatagagtaggtgtgtgtgggtgtgtgtgggggggtatgggcatgggtgttaatgtacacaattcctcctacaattctccctagaataagtaatattttgtaattcagctgtccttcccacatgaaacaacatgattatatcatggaacaggagttaaaatttaaaagaaaacaaataattgatgacattaggataaattttttaaccttccatgcccctaaaaatgatcacatgtagtaagtcagcaaggctgaaagcagctctgtgtaagatgcattatgtgatgggatgtattcctccaagcaagatcacttacccaaactgctaaatataaaacaaagatgggaccataaagaaagaatggtttcttaatgcctatttgtaatctctggaagtagagtacccaacttcagtaggtgaagagttcagtgttggtttgttgaatttgaaaagcttatcctgcactgttgtgctggagcccagtagcaagggctcaaaagagtggattctgcacatccattcccagctctctgttcagcgatagctcacattcatagcttgatgttagccatcggcagaatatttacaccatggaaataggcccacttcaagggcagtttttccagagccactgtggtaaacattgacagcacaccactagctgtgggcatatgcagctcagagttggccacgccagtttaaagtccctgggacagatcaggtggagaaacatgactttccaaattgttacttttgaagtaataagggtgtgggaggttcattgagagaaaagagaaaagcaaaagggctgtggacagactcttctgatttatgcagagtgtgcatgaaagagaaaaagaaacagaaaaagttgtcagaaagctaaacggagaaccacgaaatagggctgctgtgaaattctaggtatcatgaatggacagtggtcaacaatgccaggtgtggccacaaagtcattcaggatgagaccacaaatgatatatatttggtgacaatgaattcacaagtgaccttgaaataaatactttagataagtgcaaaagctgtacaggctgcatggtaagcagccagatgcagtggatctttttgcaggtgttaggtaaggaatcggaagcttagatatactgcaagagagtgacatatttgtggcaaggatctcattaggatggaggagattggggaatatttatagcttgagggaaatcacactgtgtcgaagaaggagttaaagatgtaagggaggggagatgattctcaaggagagagcagaagaatggactagaaatcaattattgtgggaaatgatgaggaacctctgttctctgtgggtaggaagagaagatgagtaaagtctcagagaagttaagggtaaaaggagttgaggaatttcatataacatacctttgacctcaatctcaataatatgagagtcaaggtcatcttctgaaagtctggtcatgggggtgattgtgcacttgagcaaaagggaggcctggactgtgttttatggtcaatgtgatagaaataacatttgaattgagctttttatattttcagttgcttccacacacattgactttcccacatattgatttgctctaaagggttttattccaaaagaggtggtttgttccaaaggatgcataaaattgttatagaaaaaatgaggttgactgctcttaatatcaggaaagatgtttttcaggtgaatgcaatgtgttccaactcagaaggaaaacaatgcaatttaaaattactattatcctttctcattttctcaaggactttccctccttcaatcattcctgctctttctctacatcatcagactctcccttttcttactgttcctattggattgttccttccagcacatctgcatcttcctcatccactttgcctcctttgctctgtctactttccctctctctccaggcaatctcctcccctcccatggctgtaaacaccatgtgtgtactgacaaccctgaaatgtgtgtcttcagtacaggattctcccctgagcaatgtatggttaacattcttcagaaggaactcactcctgccaccagtctccaccctgaaccttagtcagttatacaccacctctctctgatcgcttgagcctgaaacctagaaatcactgctaatttctgtttcatcaccccatttatcctatgcatcaataaattttaaaaactttacttccaaagaacataatctatctccttctttctatgtgcattgctggtgcactggcccaaccaccctcatttcttgtccagatggttgcagtagccccgacgcgtcgctctgcttctatactcgctcccttccaatgtgttctctgtaccatagccagaatggtaatggaaatcaaatctcatcacaaatgcttaagatagaagctaagctgttgaacacaacctacaaggtatggcatggtctggctccttgctgtattatttttgtgttttgtttcatttcccctcccttacatctttaactccttcttcaactgcctctccctacctgtacgtgccagaggtctgaggccgtgtataccgcacttctcactataacaccagtgcctcctttcctcttcaatttcttctttgcatttttctgaatttgtaattccatatttatgttttcattgagttgactgttatctgccttcctaaactggcctgtaagctgtgtgaggacaggatctacctggttccgttcaccactatttatccagcactagccctggaatacaacttagggctttagtcaataagtgttcaataaatgaagaaagaaatcaatggacttacagcctcttttcacgaggactagagacttctccaaaaataaaagcaatagtaaagataaaagtaagtaatttagggagttggaataatggagaattgtcagtagaaaaataaaaatggcagcaataaaattagcacatagaaatactttcagtataattcacaggtctggttgtatctgtcttgctacccaatcaaagaaagaaacataattagttataattatcgtgtttataaaattaaaaacaattgtttgtccaatagtaaaatcttagcaaaaccttcctcatgagacgcaattactgcagttgatataagatttcatagatgtgccttataattttcatacatttggcaaatcatgtggtgatggaggacaccttagtaaattaacttctgtgaggtagggccaaatatagagctttttaatggtgaagcttgatgtaagggtacagttgtaaatactacatcaatatttcccaacacgagttcttgagatggggtgggaggtgatgtatagggtataaagtggtgttctataatcaaataagtataagaagtacaatttaaacattttgtattgcagactgtctcagaatccttaatatgttgattacagtgataatcttcaggaagcgtggttcccaaatttatctggaaatcaattttgctgcacagaatacatcaagggactagggtttcagggagcaaaaacttcggaaagctttcctctaagtggatgtaagactttatttactttaggaattccatgattaattttcacaaccatgattgtataaggacggattagaaggaaatgcaagattataattgctggcaaagaatagggagtgcacctattgtgtgtccccaatctagatgaggtgtatactatacagtagggcaaagagaaacgtgagggcaaatgtcagaatgccgcctttagggtggaacaaagatgcaagttccttgggagaatcagcaagcaggagaatcatttagctcacaactgattcctgtccacaaagtcaacaacaaagaaggctgggtaaaagctacagagagtctcaagtttttcctgatgtatttttccacaggctgttagacctaaaactgaatagctaaatcgaaagcaaaccagctatcccaatatagcataacagcatgaacaactcaagcctgcaattagcccagggagaacaggactttacttctagttccctcaagtgtggaagaagcaaagagagcacagtcaagtgagaaggaacactcggcaggttcttagcaattgcaccatcttcgttcttgatttaacatccagcgtttcatgttgattagtgaatacttggttatagagacacaaattttatttagattgtttgtttatttttagactcctaggtaatatataaatatataaatatatttatatatatatatatatattttttttttttgagacggagtcttgctctgtcatcaggctggagtgcagtggtgcaatctcggctcactgcaacctctgactccctggttcaagcaattcacctgccttagcctccccagtagctgggattacaggcatgcaccaccacacccagctaatttttgtatttatagtagagatggggtttcatcatgttggcgaggttggtctcgatctcctgacctcgtgatccacccgccatggctggtaatatttataatggccacaaacagttccctagcaattgatttggaagtgtttgcaatgctgggaacagatacccatatgatgcactttgcctacagatgtttgtatttgtatatgtgattatataataatggaattgtagttccatagtaaaaaataaaaataaaaatccattgatgaatttttcctcagtagctctaataacctttacctgtatcactcaaacataatcacaagccaaggtcatggttcagagaaaaaatgaatttttggggggttttttttttggtgttgctttgtttggtttggtttttgttccacaccctcaaataccaacagaaatataacacctcctttattaaattttatattaacagcaacattttgagataactagagcataaattttttttaccatttcattctcggaagcacaatagcacagagttaaaaaataaatctaagtagtagaattttaaagctaagagcagcatctagtctaagaactccttgaactggctcctcctccatgtgactgcattcattttctttctgataatcatgaaaagttgagctccatgatgttggtaacgaaacttttattatttctgctcctccatagaaccattttgtatttatttttgaatatgtcacacattttgctctccttgaatactagactctattaaacacctaccgaaaacacagcaaagcaaaatgtaagaaaactaacaggaataatttcaaatttcaaatgatagcctctgcctttatttaacaaatatttgaggcaactgaagtaaaaaataacatgaatgctctcttgaactttaccagaaccttgtctaaggctactgctactgccttagattgcgtgtcctgaaacaaactcagatgacaggttgcatacagaaggtttataggggagtgctctctgaggatacacctgcagggaagtgagaaaggcagaaatgagcagagagagaaactgtcctacaggttggttgcaactgggatttcagctagtcccactgagagctctggagctcagatagcccttcagaatggtcttaccttgaggcaagggaatgtggtctttaaatccctggatcagccagtcatgggcctcagatcatcacctataaggggtataagcttagtggaggcagttccccgtttcagggggtaattcagtaagcgacacagctttaagctgccccatattcttgggcagagtttttggaggtagaatgctttggcctgaaggagggaaatctgggtagagtactctttcctataattataagagatgactgtatggcacccttatcataggaagaaacatttggaactactcattatttttaaaaaaatgtcttatgttagccaattagtcttcaacaggatgcccggaggaatctgtctgaatttctcatcatgttcaaagcataagttgtaattgattctttcttggcaagggaacgcagtgtgattcctctgcctcatttcctttttccgatcctcccctcaaaaagcagactcagggaatatgacctagacagtatccccatttttagccttggggactctccattttatgaattccctttttccttttccacagacactctctcttaaaatgtctgggcacctccccctctcagcctttatcctctcttgcttactttttgtcaaagattgtcagtaacttcatttgaggaaggaaagaagggagggaggagacaggaaggaaaggaagaaagcaaatctgaagaaaataaaaaacttcgacatcagatcaataaaaccacctcttcgcctagttcctatgactttttatgcaagagggtcagtgtcttttctctgctttgagttgcaggaaagaaggacactttaattagcctaagttagtacatggccattgcctagaggatagatttgtgtcaaacctaaaaaatcaagggctagaaaaatagaacccattatatatacatcacaatatagttatgcattcaaattcatttggaatttttcaaaagtgagatagaagattttaatgtggaaatgttctgtacaacttatagatgcatgtcatattaggtaagagtagggtccagagagtctcatcttctttcaaggatgtatatcttttcctgtagctaatataatctctgattattaggatttcagggctaaatgaaactttagagataaacagatgagtgggtttcaactaccagttgaaaactctggttttcagccatccctgggggatgcagcatatcactattgttgaaaatggttcattgcacactgattgtcagaggaagtggggatggggaagaggtaaggggagaagggagggtcaataggagtgtatgagaatctcaggcaaggggatgctttggaaaatccctcctgaactttctgtcatgcgtggctttccaagccgtgggatttattggtttccccaggacttttgttttacatttatggtaaaactgaggttagatgattcatgacatgtctcataattaactattgacgtgtatatgctcatgtaacgtcatgtctcactgtaaagcaataaagctttctagcaagaagagtatttagaatcccaccagaaggttccaaaaatcatccaaccaagggttcactgaaatgagctttctttggcaagcacagtatattagctggctccacgtttaattttttaaaattaagttccaacatttataatttggtacatgccctataatccagacttcggacatctcttcaaaaactgaaggatctgcaacagacagcttgcttttttttttctttttttttttttttttgagacagagtctcactgtgtcacccaggctggaatgcagtggcgtgaacatggctcactgcaataatcccagacttctgggttcaaacaatcctcccttcttagcccccatgtagctgggaccacaagtgcacaccaccatgcccagctaatttcttaacgttttgtagcagtggggtctccctttgttgcccaggctggtctcaaactcccgggctcaagcaatcctcccaccttgtcctcccaaagtgctgggattacaggtatgagccactgcccctggccagcctgcatttctgtatggcaatacttatccagagctaagaagagttatccttttagcaaaaacatgaaatcttcagttagccatacaatccttgtatcccaaattaagatgtggtgtcagttgctgcttatcattgttttcgcattgtagtttttcttacagtaaaaataaaagcagaatattttttgcgtctgtttctctatcaaagagtgaaaataagaaaatgtagtcaaaaagaccacacacttcaagaaaatacaggaaaagaatatgttctcttatgccccataacaaattttcctgtgtacaggcaaagcatgtcatgaaaaccttcttgccagcttcattcatttttatgacctgcttacctcctataggcaatagtgcttgtacatctagatctagctctatccctttatgttaccaatgatcattcagaaggagaagaaggttttaaatccctcagactacctgtgaagtctggacaagaacctagttcctcacatctataatagtacagtgttctttttattttaccatgaatggttaatagtggaaactctgtgttttctcttccctggagattgtactaatctactcttgttattttttggttttttgtttttctttttgtcttcatttgctctgtcatactgacgtgaatggcaggttgtcaattaaccctcttcccagattgtattaaaatctgagtataaaagctacagccagatccctatctcttccattatagataccagacatctaacaacacccaagtgagggttttctttataatttttcctacacagctgattgtcagcctaacttagtgcctggtagataaaacggagaattaaacttgccttttaggccaggaaattattctgttctaacattattgctcatattaaaaccctgtgccattaaagctgtctctattaaatgaatatgtgctgggtgcgttgtttattcaatttaattgtagggaaaaaaaaaactcatacgagggaaatggttttttgaactggtttttaccagtcacaagccatgtgaatgagtgtccaattaaatagtggctcactaggacttgtgtaatagtaacatctgttaccttaattaaacaagttactatataaaggcactttcatagctcactttgttagagtaggttctgacctagaaactctaggaaggtttgttctctttgtgggattttgttggcggtagcgttcccagttggccccattaaactatagacctgacaagctctgtgatctacaaacctacaatacgttcaagcctacagagcctagaggaaggagggaactgaagtttgtgatgcaaagtggaacaaataaaatagtaaaagtgctgggtaggagtgcttcgtactcattttgatgaacttgggtgttgtgactgagaggcaagtggtggtggtaacagagaaaggagagtgaacaagtatttattgaccctccattgcatgttaggctcgcaggaaaatctgtatctgcaggcataggtctacaatcctgtatccatatctttgaaatccaaaaagctctgaaaacaaaaaaatatttttctgtcttttttcttctcttgttaatctatttgtttatttctggcaggtttggagcaaactcatttggtggcaaaaccaaactgaggctattgatagactttgtctttatttaccccatgttgaatcacagaaataataatatattgggttgtgagatactacatacaccagacttttcttgggatgttatataaaataaatatactatggtgttttttaatattcaaaatcctgaatgccaaaacacaactttccctgagagtttttgataaggggttatgtattagaccatttttaaaaaggtaaaataaactaaggctcagtgatattgttttgctcaaaaatagacaactaatcagcccttccagtgacttcccattcacttcaaatagtctctgcttgccatatcctgcagtgtcctacatagccaggcccctacttatctctctgaccatatctgctgctagctagctctttctcttagctacaatcacaccggctttgcagatcctcagtgacatctagctcttttttgcctcagggcctttacacttgcttttcccactaactgaaacactttcttccctgatctttaatgaacagctccttcttgtcccatatctcagctgaaatgttgtctttgcagagagacctcaagcacattcaaaaaagaccttgctcctgtcatgccaaccaaaacgagtgtgatggaaagttagctgaattcctactggattcatagatgaaataatatcagaaagaatacagatattatgaagtttgttttttctgcctaacgtctagtacttctttgtctgaaagaagcaccctagcgatgctttcaggaagggccttttcccattatttgcacccttccttgcttttttcagtgccaagtgctctgctgttctctacccagtggaccgggttatgggaaggcacaggctaagccaatcagaccctctccttctttcaagaatcagaattttcctatgggcaggacacagagcagagacattgggtggcagctccctggggatattgctccttaaattctactctctagacccccagagctactactggttgctgtcctttccaagccctatttgttctgctttttcttcagtttgtgagttaccccatatcttttcaataagttccccattttgcataatttaactttgcttttttgaaacagactttggtctattttagttacttacaatacccaaaccctaactgatataggcaaacagatagaacatctttaatttgtatgtttttctctaaatctaacttagaaaagtaactctttaatggcatttgggtgttcatcttagtggttaaaaataattatatcttatcccatttgaataaaacaacttaagaagttgaatatctacaatttgaggaaggggagcaatttgaaacattttgcttcgcaaagatgtttgcatccagcttaactgcttacccacctgattaagtaccttatccatgactaatggagttgtcgaacatgtggacttgcagagactcatggaattaaaatggatgtatcccctccagagagccctgtttcctcgaagggtagctagcactggagtgggatgctgtgtattcccacaggcatgtgctgacatgggagttgctgaaatttggaggctgaaacattttggctgcctttgtgcaaactcaggttgtctggcatctgcatcctcccagaatgagtcattgtatgtccatgcttcattgattcttgctgaaggagatttggacaatgggcctgaacctgccaaatgagtttgggaagccccaaacacatcggtagcttgttatataagcatcttgtgctcagcagttaggcctgccactgtctgtgatgagtagcaggtccctgtcatagtgacatccagatgaggttatttgcttacctctgtgcatgacatgtgagcccaaagatgctggactaggtcctcttccagcaaaatggtgcgcattgcccagatggtcttgcataagctgagaaagaatagagaaggcaacgtgtggccactcacctagactctcatttgagctcccttgtcagtgctttatgaatgtggaggatgaaaagatatcccagcattctttgatgaattggttttaactctatatggagaccttcctgaatcccaagataatctaatctctatttccacagcccatgaacttatccttataacatctgaagttcaaattatttatttagaatttgtgtcctatactagaccttacatttcatgacaacacgagttgcctatcttgatcattgtcatatcttatgcacttagcatagtacttgacacataatggacattaaatacatatatgatgaatgaattcactagctgtatcactttgggcaggttacttaatctctcgaaacctaattccccatctgttcaatggtgataataatggtaaccatcttagaaagggttatatgaggtaacccacgagaagcttagaattgtgtcttttgttgttatcattgataataaataacgaacaatgaatcttccctctactttcaaaaagggaagtcatatagaccagtggtcccctttttggcaccaggaactggtttcgtggaagacaatttttccacagatggcgggtggggtgggaggtggttttgggataaaagtgttccatctcagattatcaggcattagattctcataaggggcatgcaacctctagatccctcaaatgcacagttcacaatagggttcaggtcctgtcctgtgagaatctaatgctgctgctcatctgacagaaggcggagcacagactgtgatgcttgctcacaggctctcacctcctgctgtgccacctggttcctaacaggccatggaccagtaccagtctgtctgcagcctgggggttggggacccctgttctagactactgtgtaaatttagttcgtgcataattcgtctaaacttattggtaatacatagatatttactgtcttctccatgactccaagaagtgttttaactttacagatgaaaaggtcctacaaggaaggtttcagtcgttcatatgtgtatatcagaaaaacaaaggtggctcatctctccacagtagtttcactggtgatattttcattgcaaattcctttttacaggtgtcaaaaatcatagtatgtgggaatgtctgcctctagtgaccttcaatgcactattaaaaaaagaagttttgttttggattgccaggattttaaccttcaaactagcctgtgtgtcatggatccctgcactagaaggcttttagaaaaacagataaactaaaaggaagctttacagactgaacatcagctacaggaagacctaggtgattcccaactctatacccaggtgccaggaaggttctaaaagtcagtaaacacagagaggccattctactacccctggcctgaggccccaaattctggtgaaaagttctgctgcccttgtagtatggagctttttaaagcaaaggcagaaatacttagaaaaagaaagaggatgagcataagatctaccttctcccaaagcagccttatcgaaagccttagtgagatggtttctaggatatagttggaacctgtctggactcacagctccctatgtatgttgaactcttagtccaagactctcttggatcttgaggtaactacagtaccataaaaaggactagatttggggaatggcatcagagccagagctttgccatctatgtagtcttgagcaagtcacttaatttattgtacttaaaatggacttaataagaaacacctgcaatgttctgctcagatttcattagatgggaaagtgctttttatatggctctaacctctaaccactgtagagtttttgttacatgcatttttaggtctatgtgcattttttcaaaatgaaattatataataccttattgttttattatttgactctttgattgacagtatatagtagataccattccctactgaagaatataacattttcattctatgtttttattttttatggcgcaatcatatggcattgtatgactttgtcaattcactacaaatatttattacttaattttgaacagttcagtttcttctttagaactgctgtttaatctactacagttcacatcaattgcatcaaatctctagtattctaattagaatgcaataccaactatgggaattaccaagcagctgtattttgggcatcttcaccaacatggttatagcaacagcgaggatttgttgagtgagtgcctaatatgtgctaggtattttacatatactgtaccttgtataaatctcccccaaactctccagctcattgtcattctgctcattttgcacttgaaggaactaaagctcatcaacatcaactaacttaatcgtagacatagagatgactaagtgacaaaactggaattcatctgtaggttatttgacttcaaaacgacataaactgtgtccactatatgaagcatcttgcttgatctcaaactcagcacatttggatttgatctcaatgtcttgcccttgtctcaaacatgtctccaccgtgtgccaccattttatgaatggtgccatcatctaccaagctcccctaactggtagcctttccttccaactgccctgagatgacctttgtgaatgttaattccccccagattgttaattctaatgaccagcttccattcttcaatttctcagcaccatttgacacaggcggtagatcgctcctccctctgaaatccttgtttcacttggcatccaggaccgcataggcccctggttttttttttttctagtccatccaggccacttcttctccatttgtctattgggtcctcctccattctacaacttctaaactgacccggggcacagtttttgggccttttttgtatatgtcccttcttccttggtgtcttcctctagtctatagccttccaacttacctaaacactggagaagtcatttatatttccagcctgaaattctcccagaatttgagtatattgaatgatatattcaacacctacctaggtctttgcaatctatcctaggcaaaaatgtcctgactccaacatataaattgtcttcccccttagtgaaaggagaggaaagcagtgaagctttgctgggcctattgatttggatgacacgtgttctctgaatcacctagagggattcattgattaattgagtcattaatgcaccgattcattcattcaaatattatttagtgactacatcatttgccaagtaccatgctaagaatctagataaaatgtttagggccaattatctaggaaataagttttctaaattaagtcaattcttaggaatcaccttttggttttcatactaaacagggaatggagtatttctgaatcattaattcccaaatcaacttttctaaaatatgcataatcgtttccaaaatggagatttatttagatgtcacacaagataattgcagctttgtaaacctaacctaagggaaattgagttttcattcagaaaccttatcttgattgcctagacatcacccagcatcctctgacgcctctgcttgatgtccttatgtcagcctgtcctcaggagagaaagaggaaacttcaccaaaatgaacaaggtctttcaccttctccctttaggttttaggaagaagctgtttatgaaagttgtcctccagtgcccattgggaacttgcaaaagatcagttactaccgatggacagtatgtctggtctttctctctttttccacatattaaattgtcattgtgtcaaatgtcttgccatcaaatacggtgctgcaaagaaattgcaattatatttatcagttttttttctctgacctttgaatttcattcagtccacagagaatccttctcggtggttcagagaacatgtgtcatccaaatcaatagagccaacaatctctgatttttctctccccctttcactgagggggagggcagttcatatattgaagtcagaaccttttaagcctggaatggatagcaaagacctacagctttagtgcatgtaatcttgcaatgcaataacctggtagtcacgcaatctggacctagtaacaggttaccacaattccatatggagttttctagtgttttcatcctgtctgcctagtattaattttgagtttctgtctctggaaaattttgtttagattttaaaatcttggtttttgttctctaatcattttctctcactataagattctgactgtcagaattaaatatgttataaaactaatgtttaaccgtagtctcattccctacgccctgccccctgccccgcaccaccccaatcacctagaatattttgaaggaagaaatgggtggtggataatagcagccaggttatctggcagcgcaacctcattttaatattagctaaagcagaaatagtcaagagggcaagtctgccatgaaaagtcttatgaaacattacaaagttaaatggaccactaaaaaacggtagacagaagagacagccaggtgctcaccaaaatcttacagttgaactttaaaagtcatatataatgagcaagattagatgcaaaatcagccataaaaataaactatttcccaagactcaaggctaaagtgcacctaaatcttatttattagcatgactgaactagcagcacagtaaatcgtaattgcatgtgtcagtcacgtggtgtttattaggccttttctgattttgagtgacaaaatacacacaaactcatctcttctatccaccatgttgactctgttctcagacaggtgtcatcctcattaccacaaaatggctgcagcagctctagacattaaatattcagatattcaattccagaaggacagagtgagaatcattttccagaaagtcccaggaaaagtctcattgtagcttactgactctgattgagtcgtataattatccctaactaatcactatagccagaagacatgaaatgctgggattaatttaagcctgggccctgtgcttcatgccaacatttagtagtggagcctactaatatctcatggcagaggctgaaagagggataggtttttaagtggctattattggatatagtgctaatggacgctggacacaactgtttgaacaagaaggaatggtcaaaagtgacagatattgtgaagaaattggaacccttttgcacagctagtggggatgtaaaatgattcagcatcaacatcatgacatgtcctcaaaaaaattaaaagtagaattaccatatgattgaacaattccacttgtagagattactccagaattaaaagcaaggactcagctagatatttgtacatccatgttcattgcagcattatgcataataatcaaaaagtggaaacagcccaaatgtctattgatagaagaataaataaacaaactggggtatacagtggaatattttccagccttaactaggaatgaaattctaacacatgctgccatatggatgaaccttgaaaacatcatgttaaatgaaataaactggacacaaaaggacaaatattgcataattgcacttatatgaagtacctagaataggcaaatggatagagacagaaagtaggataatggttacaaggtgatgggaagggggtaatgggaagtcattgtttagatgggtaaagagtttgctagagatgatgaaaaagttctgaagatggatggtggtgacagttgcacaacagtgtgactgtacttaatgccactgaattcaacacttaaaaataattaaaatggcattttttatgttatatatatattttaccacagtaaaaaagatataaaaaatggaaaataggcaaagacaaaaatcaaaggggcaatatatactcccatctaagttaataaatgatgggaatgttacttcttttttatttttaataggtaaatgatgctaattttatttcttatttttaattatttaattgataaaaattaaatattcaaggtgtacaacatgacttgtgtatatattatataatgattaccacaatcaaattaattaatgcatccatcaccagattgtacattagacccccggaattgttcatcttataactgcaattttatactctttaaccaacatcttcctatttatttcccctacctccagagcccctagcaaccatggctctactttctgcttctacgagctctacttttttagatttcacatgtaagtgacattatacactatttgtctttctgtgcctggtttatttcacttagcataacatcctccaggttcatccttgttgctgcaatggcaggatttctttctttttaaggctgagtaatagtccgctgtacatatttactagtttctttatccattaatcccgtgatggacacttgggttgtttctatatcttggctattgtgaataatgctctgatgaatatgggagtgcagatagctcttcaacatactaatttcattttctttggatatatacgcagaagtgggattgctggattatatggtagttctaatttaaatttttttttgaacaaccgtactattttccacaatggttataccaatttacattcctatcagcagtgtacaagtgttgccttttttccacaccctagtcaatgcttgttgtctcttgtctttttcatagtagtcattcttagcggtgtgagaagatatcttattgtggttttggtttgcatttctctgatgattagtgatactgagcaccttttcatatgcctttggccatttacatgtcttctttttttatttcaactttattttggattcagagagtacatgttcaggtttgtaacatgggtatattgtgtgatggtgaggcttggactacagatgaccccgtcacgcatgtagtgagcatagcacctaataggtagtttttcagctcacatcccctccccaccttccccactctaacagttcccagcatctgtttttctcattctatgtccatgtgtactcaatgtttagctcccactaataagaacatgtggtgttttgttttctatttctgtgttagtttgcttaggataatggtctcccactgcctctatattgtgacaaaggacacgattttgttcttttatatgccgcatagtattccatggtgtatatgtgttgcattttctctatccagtacaccatcagtgggcactcaggttgattccatgtctttgctattgtaaatagtgctgcgatgaacgtaaagtgcatatgtctttttggtagaaccatttatttttctttgggtatatattcagtaatgggattcctgggttgactggtagttctaagagccactgtgactggccttttgatgatattttgatttgtctaatggatttctaatttagtatttctctgatgggaggctgttgcattttaaatggatgtttccacatattgcaagactgtagcatctctaggcccaggcattcctagtcattctgacaaacagaaaatctccatgcttcccaaacgtgctgtaagaagcattgttgcctccaattaagaaacactggtttatgaggaaagaaagtgccagttaaactggctgaatggcagttttatttcatatggtacattaataagtgagcaccccattttatatactagtttctcattagttcttatatattttaagtaatcaaaatgacccaggcaaggtaagttctgaaccttcagggtgaggcctagatattggaccatggaaattcactggcataactcagtttattgaattctcatggcagcccaaccagcaccttgcctgctacctttgtaatgtgcttcttctaaatgttagcataaacaatctgcatttttttgaattatcccggtgattgcttccctggtgcaactatgattaaaaataagacagataagttctaccccaagtagcttacaaaatgtaagcattataatacaatacagaaagcaagaatccccttaagtagcagtaaaatcacaggctgcaagaatgcagggcaggcagaaagacttccagctgcaggaagcagagacagcttcataaaagaggcaacacttaagaggttcttacgtaataagtaagcagtacatttgtagaaaggttggagaggggtattctgggtatgctatgagtaatccagggaactaatgctcaacctaggaagtctagattttatgaacttatggatccctttataactccagagcaactgacagaaagatggaatagcattccattggctagttgtcttgcccaaataacttgtttgacaaaaaccgtgcctccagggaacagaagggtcagtagtcatttgagtatctgcatatatacaaagacacatatacaatgagaacaactgaggcagaaattgaaagcaaagctctcagtgtctatgtcagagcctttccccagacggtgctaagtaaaatatgtaagcacttaaggttagctataaactattcctttgggcaaggaaataaatattattacaggaaactacagcaattttttgacatcaggaaaagaatatagtcctgcaaagtccttttaggtcaaggaaattagcttctaggggaaaatatatttaaaaacaaagagtcagataatgttttcagagcaagttttcagaaggcagtctatttccagtttatgctatctatagagcgtctgtgtaaagctctttaaaaatgtaaacacctaattgcatttcagtatgataagaccataaagtctttaagtctccacaggtatttatgagttcttggtcataactttgaaagcccttttcataattatgcctatcaacatattgtgaaaaaaaatcattgaggagcttacccttggctttagaaatagtatataccatctaattattattttaatataaattatttccttaccattagattaatatctagcccagagcacatgtaattgagaaatctgtttttttatttttagaatcatactaaatttttaagtgactgatttttcaaaaaaaaaaatcttctactcatcagaaacagtttgggatctgtaaaaatcccctagtttattccagacgtaaatttccccaaagacttttagcacctattaagtttttgtctccctaggtatgagagtttgctgtcagttaagaggaaatttataagaaaatgttaaaaccagcttaaataactttctagttctatttaatgttggtacaacttcaatgaaaacatttcaagtcagcatttcaaattcagctgccaagactcaggtaatatttcctggactcaatcatatgggcatgaaacactgcagttctatcttcaaagtcctttgaaatctgtctcatgatatctttagaagaaaatattccaaaatgaaatgaagaacttcattttcagctgaattttcttaacgtctgtcaccttcttaggtgtgggttctgaattttaaatattcctctttttgaacctgtggagattgtaaaaggctacatccctagtgaaaattggtttgagataattccctggaaaacttttgtcaaggtgtacagttgtcactttggttcatgttagaaccaggagaatgtaatatgtaataatgactaatgcccctttaaaagagcatttctctcttttcttgtctgcagatatttctcatgtctataggtaccgcacgggcaagagccatactttagataaatacaggttttgagtttttttgttttttgttttttgtttttggttaatatactgtctctctcaaaatcaaaaataaaagctaaacacttgaggctgcttataatacaagttatatataataggcctgttaaaataaaacatttagacctgtagaagaaggggaatgtgtactttaataatgacttagttagtattattagtgttttgagtttcctaggattctgagccaaaagagaaatcggcaagctgttaaataaagttcattatatgaaaaacggtgttgaagagagacaactttctcctgactttaaattatacattaaatgtgttagttgaatccaggggcaggttgattgcagtaatggcccctgctttgcacatgtcctgcgtcatgtcctttggtagtgccttcccactttcactcttgacttggccagactgcttgctttggccaatgaaatggtagtagaatggatgcaagcaaatgattttgaaagtccttgcacattggagcctaccccttgcggcttttcaaatcgtttcgctaccatgcgaacaagataaaggcctattgtgccgggcgcggtgactcacgcctgtaatcccagcactttgggaggccgaggcgggtggatcacgaggtcaggagatcgagaccatcctggctaacacggtgaaaccccgtctctactaaaaatacaaaaaattagccgggcgtggtgatgggcgcctgtagtcccagctactcgggaggctgaggcaggagaatggcgtgaacccgggaggcggagcttgcagtgagccgagattggaccactgcactccagcctgggcgacagaacgagactccatctcacaaaaaaaaaaaaaaaaaaaggcctactgaatattgaatgaagaggagacaatggcctagtccccctcatcaccccagccaacacctagctgaaacatagactcaagagcaatgaaaagtcttgttattttaagcaactgagtttgggggttgtatgttatgtggtgatagctaactgatacagatatttagacaagggatatctgctaatataatggacagtgtcttgtacagtagtttttcagcaactgttgaaaaactataggactgtctccttatagcaaatgacaacccttgagagcataccttacataaaaataaagatatttttattttcctcactgcctgttatatcaaatgttgttaaatccctgctagagacaacatacccacctctgaaccagaccaccttgttattagaagagagccatcctttgaagtcacacacaacaacactgcttaatggctagggaaacaaaggctattattaatctaaaatgctttaaacagggcttagagagaatgaaataagcagactggagtttagccatggtgcaatgctttgagggcgaaaacaaagccatccatttagataagctttgaaaaacactgtgtagaggggaattcttctagaaagtgtgtcttaacttctacaatccatttgatactcaaaatttttgtgttcctgctttcagtggcacttcctataaaaatccattgccttttccttcttcatcaaagtctttttaagcttggggaaaatagacttgtcaaaaacatgtcaaagacaattacatttgaaattttaagtcatatgaaagatgtaatttgaaccccaagacttatagactctctggacctcaaaaattatttaggtcaaccctatatgatttttgaattccctccaggaaaaacctaacttatctggatctcttctgccaaagacactcccagtaatagaaacttctgtggagaattatgccccttagggaatttttatgtaataaaatgtttatccctagatagagccattcacttttaagccagacgcctggtgcagcacaggaaatcccaggtttcctttctgccacactcttccgaatattcaaagacagcagctcttctgtccccaggttcaccaaagtcatttctttgttcaccaggctaaatgtgtcagcattcttgggttgcagttaaccaaaataactctagctaactcaagcaaacaggaattttattggaaggatatgagggacttagaaaacccctggaagaagcagttttgaaactaaatgaatctaaggtgtccctctgggattaggaaacaggaaaggcagaagctgtatatttacaggaatagtttgatcagggtgcccctgctgagttcatcaggttctttgtcctgctgttccaggaggaaggagttatgtatgactattgtagctttggttgtaagacacagggaaagggagggcctctgaccacagccttaccagattgaatccagtgagaacagctatcctcaaaagaacatatgagtactatgaaaacgggaaaatggatactgagtaggcgaaaacaacaacaattaaaataatgttgaacaccattctttcatcttcatgtgaagtggctttgagtcccatccgtcttgttcctgtgaatcatccagtgtccttagctgccctcttagttggtgttaattttttcaatgaccctctcaaatggtggtgccttgtagctctagctgcagtttgatcagcgcagagtagaatggggttatcccctcccgcattctggatgccgtatatctattaatgctgcccaggattatgttcatgtttttggcactctcatctgcccatcgagtcagactgagtttaaagtcacctaaaacctagtaattaattttctcaccgtttctctagtctatgccacatctgcccccatcattatcatatctcttcctgtgcctagaatgcactcttctactttctgttattgcctagttaacacttccttttccttcagacctcgctcgtattacctcttactgagactcaatttcccttttatagatatttataatactatacacttttcctttacagtacctcatatgatataatttcacatttatgaatgtgattatttggcgtcaagatggtctagaaagaaaatctaaatttcttattacatgatctagcccaaaccttagcagccaatctcatttcttaccactccactcacccatcccactggcctttctgttccaggaaaacacaaatcctgctgtttccttagggcctttgcacttgatgttctctctcattccccattctttgtctgaccactacttatcatcgattagatcttagctcaagtaatacaaagagaggccttccatgtttaacctaaagaaattccatcatcttttgtgcccccaacacacaccaaaagtccatttctatcataagactgtccatattttcttcttagcacatattactgcactaacttatcacattcatatttgctttatttgctttattgttagtctctccttccactgaaatgtgagatccttaagagtaatggcattatttgtcttatttattgttggatacctaattcccagaagagtgcagggcccacagtggatgctcaggaagtatttgttgaattagtgaattgaagaatggtcataaacagaataaattgtcttttccaatagagtttaagtttcatgaagggagcaaccgtatcagttttgttcactattgcatctttagtacattgcctgacacatagtaggttcttattacaaatatgtttcatgaatgcaataccatatttgcactattagtgtttttgagcattcatagggacatttatatttcagggatatttatgttcagacctgactgatacacaatatgtgagcttttcctctcaattccctatcatgaggaaaagaaattggcatcttatctctacctccacccaaagtaatcggcaatttcattggagaaatttttagccaccactgagactagttctgcataagaaaattagactgagatctagcaatttactagggccatcagtttaattatgaatatccaatgtgagtaaatcagacttcaaatgatacatgtttttcaccaaattgcttagtaactctgtcaactcttccattcattgatctctaaaattggaagacttgaggtgaaattccagtctcctaatgtgtagttcagtgtttctctgactttgggagcatataaatcacctaagaaccttaataaaatgcagaatctgattcagaaagtttgggatggggcctgagattgtgtgtttcttataagctcccatatgtgacatagctgctgacctcaaaccaaactttaagtaaggaactagataaccctggataataatagcaaacaccagttgtaagcaagtgtagcactttgtagttttcaaagaacttatttgtaaattaatttttaaaaatccctacaaagacacaattattcaggtatagatgaggaaactgaagttgagaaaactgacacctttaattgaagtcgcacaactagaaatttaaccaagtttctccttccacaactgcagttgtttccccttcacatcatctgtctggaccacattcacccactcattcacagtaaatttaattatgcttccatcgtgccctactcgaggggttgaagatacagcagtgaatgagaaaaagatcttaccaggttttctgatgtgtaaatggaatgattggcccttcccaactccagtggtctgtgattctattacggtgtgccatgtttaaaaaatgaaattatagaattaaggcattatcttaggtatcattttctacctctgtgctctcagaatcaataaacttaaattcagctgatcatcaccgtcatacaaaacttcctcccacattctttgtctcattgcagacaagcatatcggagccaaatttcacgctatccaatcaataattaattctcctcctaactgttcctcctaaattgtattgttttgtgctcctcctggccactgctgccctagttcaggttttctcttgtctagtctggcagtgtctagaagcactttctctggtgatggaaatattctatgtctgtgctaatgcaatacagtagccacttgccgtatgtgggtattgagcacttgaaaggtgaccaacgcaactgaggaagagaaattttaattttccttaattttaacgttaagtttaagtagccacatttgcttagccatctcttggacagcatgtgcctggatccttgcaggaacttttctgcctggtttccgctggcttcttcttatatctaaattgattttcctcattcattcaccagcatgatctttccaaaatgtaaatctgatgatatcactcccatgccttaagttcttatcctgggataaagtctttgcttcctatgtgactggcaagggtctttgtgacctgacccctttctgaacccaccagccccgctttctgcctcacagttaatgctctgacaatgagctaccaccttttctgcatgtcgtcccctgtatgtatctaactcctacatatcccttaagaatcagttcatctccatgaaaaattatcattgattcatccccacccaggacctctactatgttttcaggatactctatagatacatatatcatttcagggaaccacattattttatctgtctcatatttattggtggtgatagtggaaattcaccagactgtgaatttcctaaagggaagggttatttccaattcatctttattgactgagacactaccataggtagtgagcactactagccattgaatgaatgggagatgaaaagaaggagagatggaagaaaggaaagggggattaaaccagctagtatcaaattttaaaaataaatattggctgttaactgttcgggaatctcaatttttcagttaactttatttttttttacagttgatagctagtataaatctcagttagacatatttggatttttggaggactagtggataggtttcctataaacaattgatcatttgaatttagtttcagttgtacaaaataaaaggcattcaggcactgaaagacaaattttgcacgttctcacccacatgtagaagctaaaaattaaaacaattgaactcgtggagacagaaagtagaataacaattaccagaaggagggaggggtggaaaaggggtgatagttaatggatacgaaaatgtagttagacaggatgaagaaaatctatcattcaataacacaatggggtgactataatcaacaataatttattgtatattttgaaataactaaaagcacaaaatttgaatgttcctaatacaaagaaatgataaatgaggttatggataccccacttaccctgatgggatcattacacattatatgcctgtatcaaaatgtcacatgtatcccataaatatatatgcctattatgtacccatagtaattaaatatacatttttaatgaagaaagaataaataaaaggcattgtatcttctctacatagacagattattttaatcagccaaattatatttccttttgctaaaatgtctgagctttgactatattgactggtggacttttaaagccagaagacactaagttcagccatattgtaactgctcaatgggttcaccctgcctgctgcctagacagagcagatttatcaagacaggggaattgcaatagagaaagtataattcactcagagctggctatgtaggagacaggagttttactattactcaaatcattctccctgagcattgggggatcagagtttttaaggataatttggtgggttggtggggagcagggggcagtgagtcaggagttctgattggttgagttggagatgaacacataggaagtcgtagctgtcttcttgcactgagtcagttcctgggtgggggctgtaaaatcagatgagccagtttattgatctgggtggacccagctgatccactgagtacagggtgtgcaaaatatctcaagcactggtcttagattttacaatagtgatattatccccaagagcagtttggggagggaagaatcttgtagcctctggcctcacgactcctaaaccataatttctaatcttttggctaatttgttagcctacaaattagctggggtctaatccccaggcaagaatggggtttcttatgggaaagggctgttattgtctttgttttaaactataaactataaactgagttcctcccaaacttagtttccatcccaatgcccaggagtgaacaaggacagcttggaggttagaagcaagatggagctgtttaggtcagatcgcttttcactgtctcagttataattttgcaatggcagtttccatatcatttttcagaggaaaaaactatacaacttacccatgattaatcagtaagttagtggtgaattcagtagaaactggtgtgtatatgaacacattcttgaagtctaaatctggaaagaaaggcattttgtttttcaaatacctacttcagaggagttttgtttgcttttttttttttttttaatgacaatgattttggttgagattttacttaaaacaaaagttacaaagttgtgccgcctttggtacttcatgctgtgccagttaacagtggggtgggtcatctgtctatgaaccatgaccattttcagttgaaagttagggaagtctgccttatctcaaaagcccttgccttcaggcttctgttcagatggtatcagctggaacaaataagctgagattgcatttgctgttttttgtgctaatctcaagaacattccaaaaatggtttgtcagcagctgaactgagcacagaatctgtgggcatgaccatatttctcctcacaagaaaaatcactttttaagtttcttggaagttgattacaatgtgctttttgctccctcttcaaaagtaagataagtatcggaatctgtcattttctgctttggatgtatgcctaaacagccaaagaagcgcatcaaaaccaaggaaaaaaatgtggaaaggccaacctaaatgtatatagggtatagtccatccacagactatagctacacagacaaagtgaggtgaagaacttggcagttatctgagggattttcccagtttggttgatgcactcgaccatccagagttcctcttgttaagtaactttttgtctgaattttctgaaaaacagaaatagcactaaagatgaatcctgaactctgaataattgtattgtaagtcagaaaaaactttttgtgatcagccactaaaagggaagtcacaagaagagtccaccactactaccaccaccaccaccaccagagcaaacttgtttacagcctctctgagtcattactgtgctaggttttgaacacagagagcaaaaggactatattgcatgagcttatagactggtgaggagacaaacaaggaggtggacagttataatcaggatgggcacccatgttgacccccttcttctggtgtttcagccatttgatgcatcatctatggacacacagatgtttcctctgtatacactgtctcacaagtgacactgtgtattcatcaccactcttcaggttgcaaatgactgaaatccaacccaaactggcttatgaggcatttttgacaactttattgaagtataatttacattccataaaattcactcattttaagtgtacaacgcaatgatttttagtaaattgtactaagttttgcaactatcaccatcatctcattctacattattttcataatatttcaaagggaatctgctgactcacgtatctgaaaatttcagggtttgctgtatgtgctaagggaatatcatcaagacttcatttttgttggtttcattcttagccaatctattccctggtgaaacgacaaatgacccctagcggattatctaccaccttagtaaccccagcagaaaacatatacctcttttccagttgttggaacaaatgtcttaggatgacacacatttatcctgattggtctaggctaggtcaggtgtccactcctgaaccaatcgctttaaccaggagtgtgtgatgctctatctttggccatgtctgtgtcacatgaacaccccagcagccagagaatggtgttacagccacccaaagtacatggtctgaaagtggggagacatgatttcccaaaggaaaattgggattattattattattattattattcctagacaaagagaaatggatgctgtgcaggcaatacagtagatgtccaatccacaggaaaattgtgatcagagtgacgttgcttcttcccttttgaatcccctgtagtggttatcacacagccttttatatagcaagtactcaaaaaatatctgtggattggtcatggacaggctaaaacatagaacagaccaacaatgacagacttttactttcttattttattgttggggaaggctaaaaaattaggagtatgatttcaattattaaagctaataaactggggcttatctgagaggccacatgggagcatgatggtcagagagcggctggatgtgtgtcagaactcaaaagcagattgcagtcagactcttcccctgtgtaggcattgagtacgtagatatatacacccacacacacagacagttgacccttgaacaactaaggggttaggagtaccaaccctctgcacagaaagaaattcacatataacttttgactccccaaaaccttaactatcaatagcatactgtttttgttgttgttgttgtttgttgttgttgttttaagagagacagtcttgctctgtcgcccaggctggagtgcagcagcagcataatcgtagctcattttaacctctaactcctgggctcaagcaatcctctagcctcaccttcccaagtaattgggactacaagtgcatgcccccacacccggccgattctttcatattttttgtagaaacagggcctagctatgttgcccaagctagtctcaaactcctaggatcgagtgatcttactgcctcagcttcccaaagcactaggattataggcatgagccactgcacgtggactaataggctactattgactagaatgccttaatgataacacagtttataaacacttttttttttaattgagacagttttactctgttgcccatgctagagtggtgcagtggcttgattccagctcactgcagcctcgacctgctgggctcaagcaatcctgccacctcagcctcccgggtggttgggactacaggcgcacatcactacacctggctaatttttgtattttttgcatagatggggtttcacaatgtgcccaggctggtctcaaacacctgggctcaactaatccacccacctcagtctctcaaagtgctgcgattgcaagcatgaaccaccatgcccagccaattaacacatattttgtatgttatatggatcatgtactgtattctttattattttttttgagaccgattctcactctgttgcccaggctggagtgcagtggcgtgatcccagctcactgcaacctccgcctcctgggttcaagtgattctcctgactcagccccccgagtagctgagattacaggtgcccgccaccatgcccagttaattttgcatttttcataaagacagggtttcaccatgttagccaggctggtctcaaactcctgacctcaggtgatctgcccatctcggcctcccaaagtgctgggattacaggcctgagccagcacacccagcctacgctgtattcttacaataaagaaaataaaatgttattaagaaaattataaggaagagaagaatatattgactgtttattaagtggaagtgcatcatcatacaggtccttatcctcatcctcttcaagttgagtaggctgaggtggaagaaaatgtgtgtattagtggacttgcacagttcagacccgtgtatttcaatcccgtgttgttcaagggtcaactgtatatctatctatctatatctatatctgtctgtctgtctgtctatctatctatctatctatatatatatatatttggcctttcttattgctctttcatcagaagagtaatgctagtgaatgatctggaattcagtggtataccataagctggcaagaaacctggcaaattgtaatttatattcacaaaacatttttttcaaactatgcaaatctttacatctaacagaaaaacaataagcagaattctagaacctttggaataaataattcagtaccaatagatacattaaagtatattgtttatagaaaggatcagagttgaaaattgttaaggaacaacctgtattttaaaagtaaattttataccatttttcctaaaaggaatatggttcacagcaaatttcagatccataaaaactttatcttctagtgacttttaagattctctttcttgacaggaacttcaagaatggcaagatatttctttcttccacttaactgcaatgtgactatgaagatgctgtaaacatttgcaaattaggttgtaaatagcagcaatgaaagcattaactctcatagccacattttcggaagtgcactttacattatgtggagataggtattaagaaataaacctgaatgcttatataaaaattatgctggagataggtattcagaaataaacctgaatgcttatataaaaatccagcctcctattttccaagcacagtggtataattacagctctaatttatggcatactttgtaggattgctgattaattatacagacctcctgatgttttatattcttttcaactttgtttccctctgctatgtgaccactacaaagcgagtatccctaaatcacttattattcaggttacctaatttttaaaaagtgaatttgctattaacatcattttcttatatagcactgtaacatttatatgttaaaaattattgtactccttaatgttgcagctaactcatacacacacagacacatacactcactcctacacatacacatacagacacacacactcaaagattttaataaattcccgatatttacccaatgtagacatgtctaacagttctgcatgacttgatctgaaatattgaacacttcaacagtgcaacaaagcatgattcgttagggataatactaaccaatctcatttttaaactgattatagggatccaatttgaataatttgctgctgtggattatttggaaacagttgtagcacattttgtttgttgctcgaggttatcagtgttttcagaacactatcttcctttcatagttcttttgagtttaatagttatacaaaagccccatttaccagatttttcaataaatgtagtgtgctgatgattacaggaggatttgccagaaaactcctttacatatacatagtgcaatatcttcagatattatcctcttctttgctttaagtaggtcaggttcacaatgagctgttctccttaaacccctccccttcatatccttatcaaattccctttatcactgtcacatctaaattactatcttctgctttgccaccaagacatttttaatagtaagagcttcctgctcctttcttaagctcttctctttttcggtcatcaacttccccttggaattaggaaaaggcccttgtagatttgggctattaaataggagaggacccatgtatcaagtccttaaatgttctgtcatcatgagaattatttattggaacccattacctgtgcgacttcacagttctttttagatggtttgtctgaaaagaataaaggctcttcgttgaaatgaaatcgctttctttgctacctagggaagaaaatagttgagtctaattatttagaaacgagaggaggattgctgtaaggacttgagtcgatcatggaagtttctcctatgcaaaacagatctgaaggtacagaaaacataaaaataatatccctgggaagagaacacccaggtattaacttaagcacatagcaggctttattgagttttacagaaaaagtaaatacagctgacacaacctcgagactaaaatttttggtgacatctctgtttatcccagacactgatttctctattcagttttgtgatgtggagagtattccgaaggcctgaaagtgttcaaaaccattgtgcatagcttcattttgggggagaatgttataatttgcttctgaaaactaagtaatctctgacctctacccacacatcaagaaaggttagaaatcagtcctaatcccaggaattgtcatcaatgtctctaaaattctaaagactgaatgaattttaatccaataatcaacatatttaatgtgtgcctgtttgtatataaaggactgtataaaatgaaagggagacagagagatggatacgacctgggatttgagttctggaaatcatttgagtaaatggggtgatgatatattgaggaagtgtaacatcaatgccatgtgaatagattgggcagctttggaaggtcatgaattggccattatgcgatttgcccaacacagtttatacttattcataccattgtaagaggaagttgatcatgggagaaaggttgaaatagatgtgtgtttcacaaggtacaagattggcacttctccaagtactcagatcatcttggatggtacacagtatacagacattaaaaagcactgagcaacatagttctcttacactccttctgagaatatcaaggggaaactcatggttggtcctagcatatctgaacacttttgaaatcctgagtaatccctcttttactgaaacaaaaaaagtagttcctaggctgagaatcctgggagacaagtttacctagctggaatataataccttaggtgggtttttatcacatttatttttatgattaccactatttatggcaagtagatactggtttccatgtatcatagcaacaagtttcctttattctttaattttgaactttgaaacatttaaaaaatattgtgactattggttattagaatgatactgaaaataataacagaaatgatctttgcagctaacaatgaccagctgtttaccatgcaccatcacaggcttaaatgtttcatgggaatttttacatttaaccttctcacaaaaaacctatgaaattcaggtgcttgttaattatgacccccattttagagatggcagtctggagcccagaggggttgagactcccaagtcacacgtctagcagataaagaggcaaagatttaggctgtcttgtagtacatcaatgtggccgaaatggagagacgtcagttcaggaaagcttagaatggatgactgttggtgatgctgagtttctgtgcttcccagaaggcaaagatgcagctgttttagggacagggagagaccttggggattttaactggaccgtgacagtggtgttctatcatgatagtgaatgagctagtagattccactttcattttctctcttagaaatattatgaagttctggtattaggggttaaagcaaataaagcatgatcctgccatcaccaaagagttgcaaattggatgcataataaaattaaaacattttttgtttctggcatggccaatattgctatttgtcttatagaaacctcttctcattactaaattatatattctgtatagtgggcccccctttctaattaataattaatattgtcttccaggcattttagttaccaagtggtaaaggaagcttctgtgatttcaacttcaagttatttttcacatattctttacttttgcttctgctttcagacacattaatagggacacatatttctcaatattaggaaaagctatttcaacaagtaaaattagaaagcaaacagaaaaaaaaaagaactatttaattataaccaaagatctaatggtaaatttaaagaaaatctcttaaatgtggttacattttttacttcttgttttatttctttcctacaccctccaacactgcaggatagcatggtaggaagggtacaggctctctagtgagccctgagctcaaaactccactctatttcttgtaaatgacattgactttggatgttttaatttactcctctggatttcatttttcttaactgaaaaatcaggataatgatactcctcagaattgtgcagattaaatgagataatcaatgcaagcagccaacagcacccaataggatgttgtaagtgcttaataaacttcttaagcatctccatgcgcccaatactcaacttagtatatttacagtttttcttctgggtctcttggtccatttctgtccacgtcttctttatttctaattatttctagagacagctgcactttgttattaaactattcttttacaagctactctgctgttctgattttgttatataaagcttcctgagtgctttatatattttaatgtttttttctcattataaaagttatattacttattatgatgctttggtaaaagtatatggaagtatagaaaataacaaataatattgctttaaataatattactttcctgtccttacccccattcatcctcacaatgccttatggaattatgttgaaattgtctcaggtcctaaattctcagaagaaaggaattctaaatcttatattagtggaaacatggagatcttgcatcaatgaaatatagcaatttaagaaacaaattttaggcaaaatgacatccaaacatgtcctttactttatttccttttcccaaagacatggtgtttctagtgttatatgcttaccatgtgaataaataaaatcacaaaattttaccagcccaagaaaagcatttctcatgttcatcatgcactgtgtcacgaagaacaattaaaattaactctgtgatctttaatactcatccagccccaggcagagagttattgccaggttattttaaagggctttcaaactgttgttcagaggaagttaaacctgaatcaaaccaggttaaacaaacacaagtttattttctcttttgagcaatgctgcagacaagggcaatagggtctgaacgcagcttgttcttcaggtggcctgaaatgcacaggttgttcagcagtttattaaacccaaatcttacaacagaaagcaaattatctctaagggaactttgtcaccagggtgtctgttcaatagtgatgtctattgccaccacagagactacacggaaaggtcaatgacaggtttgcctgaaattaccccgggaggaggtgtcttcctattgacctacattaaatttgttatccaaaatacctttttttccttaagatggggagcaaagccatcttctagaggtctcaattgactctttgtaaattgcaattaccacaaaacaatctttctttctataattcaaaataattaattccttcccatcatgctgagaatttccacgtatcttttgaaatcaagtatgtaagcttgggcaaatttcagctaaaagttaaaataccttttgaattttatgaaaagagataggcaaggaaattcaaaccaaaacaagtctttttttttttttcttttcagagaaaagtcttggtgttatttgctatcaggtaggtctatagcatacagcctacccatgccaattaatctgccaggcttttctaatttctcaactggcacaaagccagagacccctgtactgtatccgtatgtcagctcttgcagtcacaggctaattctcctgttgataggttgaatatatgaatctttatctctgtctcttcattgtcacctctctactccttctacattgtgactatttcttgggcattgtattccaaaattatgctgtattgcttttgcctcaagggcaagtaaagacaatgcctttctcataagcagttcagctttcaggcagaacagcttagaataccataggttgccattttggtgtagatcctcctctgtcttattttggttataattttaataccaaagtaaatatttatcacttggccagagtaacaagaaaaagatcaaatgagagatgtagtttaatccaaccaacaaactgggttaattacagaagaaattaaaattgcaggcaggccctaatcttttttttcctactggacttttattctttgatacattacccattaccacccccaaactgtcttttatactcctcatttgattgttattatatcaccgagagagcaataattgcaagtctctgttagctgctgttggggaaaaggccaagccttctacaggctggaaggaggctgagcagtgggcatgggaggtggtgccaggcccacaaaagcagaacccctcctgcgtatcacttcctctgcccctcgtctaagggcttcaaacaaggtctaacagccctggggggtttcctctcttgatacccgttatgggttaaacagtttccctataaaaatcatattcacctagaatctcaaaatgtgaccttatttgggccctttgcagatgtaatcaagttaagatgagatcatactggattgcataggccctaatccaatgactgatgtccttatgtaaggagagggaaatttggatacagagggaagacaatgtaaagagacacacatccgcaccatgtgacgatggaggcagagattggagtgatgcctctgcaagacaaggaacaccaaaaaacaaaagggccaacagccgccagaagctgggagtgaaccaaagggtttctcccgcagagcctccagcagcaaccaacctggccaataccttcatgtcagactgccatcctccaccactgccagagtatagatctttattgttgtaaagcgcctagtttgtggtgtgttgctatggcagccataggaaactactaccacaccacacccatcgtcccctcccactgcattgctctgttctctctgtccagtatgtcttgagtggaaacattgaagaggggatagatcgtggcctcataaccacaggctaccctaaatcccggccccatgtactcaggcacatgctgctactggtttaaagtcagggttcacagtctcaaaggcctgcaggggcctggtaggaacattaaagagaggttcaagccaggcatagacgggagctagaaaacccaccatctgctcaagagggctgctgcccgtctcctccagcctattggtgccctaaggggatatgttgccagtattgccctatcttcccatatgtcacaattagccaggaatgggcttttatatgaaatcatacaattattagattgttattttaattgtgtagaaaaagcaagctcatctgtggctgtgaagttcctctggtctattaatgacaggctcgctgacacgtgcccaattctgtcctgccttgtgatgtacgtgagacctttggttgggggatgcctgtctaaccgccctcattctagggcatcgctgatggcccctggggtcagcagtcttcctttcctggagccaggcctcctgtgacagctctgccatcctcccctctgccatcctcccagtttgcttaagctgagaagtagtcttaccgaaatataagttagtcgctcaccccttgcagagttcaattaactggagtgaggtctggtataaagaaagcgatttattccaaagctagcttggggaaagaaatacagatgtcctgccttaagtataccacttcacttttggaacagaaaacgggtacttttcaaaggtagaggaggaagcaagcaaaacgtgatagctctggtggcttatctacgaggtgttcgagcttgtgactgccggcacctttgtggacaggactaggctgcaaacttaccaggtgggaaggagtttcctatctcttgaggcagtcacctggtaggagggagttttataaaattgaggcagcctcctggtgggggaaagtttctttctggggcgcctaagcacatagttagatgaacttgcccggtagggagtgtctggtgaaggggaggtaaaaggctatatttgcatttctaaagggctatgtaggaagtggggaaccaggggaatgagaagagaaaagagagagaaaaaaataattaaaccatcttagaaaaatggggctacttggtgacagtagcagtaattattttaactatgtttgggattctgtaataaattttagctcttcaggagtttagcctccctcgtaatgtgtaaatctattgtttcactttcaggctttcagctttcaaacacgttttctggaaccaatcatgtataaaagagagtagaagccttttaaggccctttgagttttttttttttttaattgcacataattttaagtgagctattttattcttgatctaacaataataaagatgatttaaaatttaacataacagtttgtcacttttttgtgtattttgtttgtttgttgaaaggaaatgatcactccataatttctttctttgcagaaggagagaagtggttttctaagttgtattctgaagggatttatttctaaggaagtgtttcagtgtgacttaaaggcaagcaaggatacgctgtctccctctacagcagttaggcttcctgctgaactgctcagaaaaatcataggtctccattttgggataatcctcctcttttgggtgatagagtgaagttggcagctttcatcatgtgttactaaagacccccccaaaagaaaagatcagcatttttaaaggtcctgtgtccccagactggttttgatttataggactgacaatgtcaacttttcaatggctgcaactcagagcctcatgtgaagaaagatagattcaatttatctcctgagtccagatttgttcctatcctctgtggatccaaaatctccaaatgacagtgagggaacaactgcttctctatgctctaggtaatttactgtgttgtgaattagatgacctcttttcatgtagggaaaattaagtcttgtgtcatgtctgtatttgtactacttgctgctttatcacctttggcttttctctgttgccaccaataatttaaaaagggccacaggtaggtcaggactaacctgttctaagccaagaacagatttacattttcaattcttttcatcttactccatcactattcataagtattaggaggagctcaaagttcactatcaccctaatagctacaagtcagtcagtagtctaaattgaggaaaccaagatgagatggaccataaaggaaactttgaaatctcatccagaaacaaacatgaaaataaagctattaaagcggcgctgttgtctgaggtaatacccgacgtttgacatctcatgccaagaaaattaaggacacgggcacacacaaggagtgagtttagagccgaagtttaataggcaaaagaaagagaaagaacagctccctctcctgcaagagagaggaacattcaaatgggacttccggcttgtgttggagtacaccagattttatagacaggcttgaggaggcggtatctgatttacatggggcccaaagattggatagaccaggtgtgacgtttacataactcgtggggaagctggctggaccaccctaatattatgcaaatgaggtctttgcctggccagcaccaccctgttgtctgcttcttgctgtacacgtggctggcaaagagaagggacgatggagccactattttaaacatgcctagtcccaggtagtcttttcctattggcacagctgccagcattcacccatgcacgcttccagcttgctttgtctatgtctgcagctcgattttacaagctgctctttgttagaaaagaaaatgatttaggggctgcttttcgttaaaaggaaaacctgggccgggcgcggtggctcacgcctgtagtaccagcactttggcaggccgaggcaggcagatcacgaggtcaggagatcgagaccatcctggctaacacagtgaaaccccgtctctactaaaaatacaaaaaattagccgggcgtggtggcgggcgcctgtagtcccagctactcgggaggctgaggcgggagaatggcgtgaacccaggagttggagcttgcagtgagccgagatcgcagcactgcactccagcctgggcgacagagcgagactccgtctcaaaaaacaaaaaaaggaaaaccttaccgaggactcccgtaccctcactatctgcctaaataatttctccttaactcctgtatcactatccttggactggatttaggtactatattcatgaaaaaaaaaaagaatgtaatattagtggaaaaaccgtttttctaagttggtagaagatccaaatggaaaggaagaaaatatctaagtatttatattgagttgcatttcaaatttttccttgagctagccaaatttgtaccccaaggccgaatgctagctttatagcttatttctggcttataaaaatcccataaaacattggccgagtgtggtggctcactcctggcatctgagcacttcgggaggctgaggccctcggatcacttgaggtcagaagtttcagaccagcctggcctacatggtgaaaccccatctctactaaaaatacaaaatattagctagacgtgggggtacatgcctagctatcagggaggctgaggcgagagaatcgcatgtacccaggagttggaagttgcagtgagccgagatcgtaccactgcactccagcctgggtgacacagcaagactctgtctcaaaaaacaaaaaaatcacataaaacacattaaaagcaacaggtcaaattgtatacttagcctttatatgcagaaaaatatagccaaaattatgtgatacagctgtgtatgaagaaatgtcaggtgcttttttcttcatattcggaactgtgtggttattcttccattatagatagcattcgtcaatcttctaccgaaaagttctatcaaggcagtcatcacggaatcatcttcagaatccattccttccattctacttttactaccaccgtcacctgaacaagttcagcaatttcttggaaagattgcactcttcctgttgtcagggctgaaaactcaatttctaacatcttatattattggcttatataactggggcgtccaaggtgttgacttccaccgtggacagaaatgggctcaaaaatgtcataaggtctctgcttctctttctctctctctttctcttgggctctgtttgtctttggatggcttccttaaggcatgctttctctatatggtaggcaaaataattgccaacaattctagattcccatcttccaaatttagcaatcccagcagaaagagattgttttctcaaagagctcctggttttgatggcatgcttctacacccatcactatagacaagagaatagggtctcctgactggccaggtctgggtccctgcccatctttatacctagatagtttgtcaaacagctttcccattgaaaacagtaatgctcattttactgtgtgcttatagaaatgtgtatgttattgtatggaacacattggcattatttctagatatataatcatcaaaagtaatgatttattatgagcttgagaacaaaaacaataattttcacatcactaaaaaaaatagcacaaagcttgccgggcgcagtggctcacgcctgtaatcccagcactttgggaggcgaggcgggcggatcacgaggtcaggagatcgagaccatcctggcgaacacggtgaaaacctgtctctactaaaaatacaaaaaattagccgggcatggtggcgggtgcctgtagtcccagctactcgggaggctgagacaggagaatggtatgaaccctggaggtggagcttgcagtgagccgagatcgcagcactgcactccagcctgggtgacagagcgagactccatctcaaaaaaaaaaaaaaaaaaaaaaaaaaaaaaaaaaaaaaaaaagcacaaagcctaatatataggaggtatttagtaaagaactatgaataaatgggttcaatatatcatcccccttctgtgtctatttggtgtcacccatatgctttgtgaggcatcataatgtgttgtaggacttcagagtggcagaactactcagcagttgtcttagtcttaacagaatcctttgtaattgcttgaaacagtgggtccaggaaggcacagagcttcacttaatagaacatgtggctaactctggtctattcatgagtgtctcactgacatatgcccaagcacctgtcccgcctggtgtattttacatgtcaggcatcgttctaagcaccgcacatcttaacaacaactctatgagatgtatatagttacttttattatcccatttttacaaacaaggaagctgagttacagagagattaactttcccaaagtcacacaacttctaagtagtagaagcatgatttgagcctagacagtttagttccagagtttatgttcttagttactacactatattgctgtataaaaaagtggttgagtttctccaaagaatagtttatcaaacttcatattacccccacatttggataatagtaagaataagcggtcacagcaatatgttgtgatttaatgaagactactgaaaattaccccttctacaaatgatctccctcactgtctttctctcatctggaattctaacagttagggtcttacctctcttacttacctctttgcaaataacagtgggagagttgagaccctaaaccaatatcaggcactgaaatatttaaaatgaatagtataatagtttataaaaattattttgtaatttcacaaggcccataggaaattggatagggaaactctgaggacaaggggcaaagagagccttctactacgactgtgaaaagctagctggcttttatgcaatgcagataccaaaagcaggaagcaggatggaaatgatggtggggaaaacatttgaagagtgtgaagcactttaagttaacgaaattttcacctatcttatctcattatagaagaagggattttaaaaactgaattagaccagcagttctcaaatggggtgattttgacccccagggtatctttgacaatctctggagacatttttgattgtcatgacgtggggaagggttagagctatgggagtccagtgggtataggccagggatggtgcccattatcccccccaggacaaagaattgttcagtccaaaatgtcgtcagtgccaaggttgggaaactctgtctcagagcttgcataagtaacttggctatgccatatacttgacaagtttcagagtcaaggctagaatccaagtaatctgatgacaagtcctttgcttgtttccgtattcatttccttcagcatgtcagagtttgatacaggcgatggctttaggtttttggaatgatcgtgatactgtttttaatggtataagttattaataggtgtttttgcttttaaagagtcatctcacccctcagaatgtttaatatgctccaagccagtgttacctcatgaaagataagtctgtacataaaacacaaatgtcaccttacatattgaattctcatatgccagtgtttcacaatttctagcaaattattttataaatggaatgtgactaactcctttaaagctatttttgttattattgaggtaattaagatttgttcaccactctgtttttgtcagtgcatctgctccttggcaaatgaggtatcagatggtctttactgagcaactgttatatgcgtagctgtgatgtgaatgaacaaaaggccttcttgtctgtgtcttttttttagccagagcttggatttagcttacgctaaattatttttttaattgtagatttgagatgttttattatgagaagttggtaatcatctgtgtaaactaataagaactgaaaattcatcatacatttacttatttttttaccttgatcttctagtaaatgtttagcttcatagatttaggctgctatgtaagaacattctcctttatctgagtgatgtgatttaacagagtaatttgtttatgagcatctcttattctttctttattggcaggaggacttgcacctctgcttctcattttgtcactttgggttcagacacctctgtaatagccatcactgggggcagatttcagtagactttgaaaaacttgttttccctgaggctccatatgcttcctggtttgcaaaatataatgacccgcaaatccttcaacaacagcaatggttaggcctagcagttaccacctcactggccatggctccagctcggctcccttgcctccaccagaagcatgggtcaccccagcccaaaggccaagacctccaacgccaggcctctaccagaaagcaacataggcaccgccagcaggtacaaactgcccaaccacaggtgcccttgtgccttgtctgcctcttgtaccttgattcgggatgactcagttaatttgcatattgatttcaaattgtcagaagtaacagtcaaaatacaaacagaaggcagaaggctgatgtaattactatattaaaagaaaatatattaaaatgatgttgtccaatttttcctatatatacaaatgaccaaataagagaatactttttttttttttttttttcgagacagggtctcgctctgtctcctaggctggagtgtagtggtgccatctcggctcactgcaacctccacctcctagattcaagccatcctcccacctcagccccccaagtagctgggactataggctcaagccagcacacctggctaatttttgtgttttttgtagagacagggttttgccatgttgcccagactggtctcaaactcctgagctcaagtgatcctcctgcctcagccccctaaagtgctagaattacaggcatgagccgccacacccagcctcgcaaacacaattttaaagatgaaagagaaccactgcctagtaaatatcaggaaacctctaggaaccttactgaccctatcttacctaattcttgctatcaatctataagatggacattgttagttctgtttcatagaagaggaagtaaaaactgagaaagttaagtaagttgtctttagtggtacagctagaacccacagctctggaatgtgaactcccatccctctgattccaaaattctttgtagaattcttccaccttcataccctctcatcagactgagtcatagatctggaccgggtcttcaggaagactgtagcttctccatctgtaagagccttcaaaaaagtatatgcagcatttgcaacccagcgcatttacatcttcacctgtgtttttataatgcttgctcaaaagttctatgaagtgaggctctgcccatcctagacccctgtttcagatatttgaaaggactctgttaagtatagcactagtgccaagtggttcaaccactctgaattcctacaacgtattaccgatttttcccttaggttatttatttattcatgtatttactcggccacttaagaaatatttctagtatccactacacgccatcctgtgtactagacccaggaggttcagtcgtaagacagacaccatcccttccctcagagatgctaccattccatgtgataagacaactaagaagcaaacaaataaaatttcctgattgaatttagtgggaagaaataaagtggctgcaggaaaacagggagacagggagaaccaccgtaaacagtgagttgggagagatctatcaggaaaagctacctctacactgagatcctgaaggtgagaaggtgacagctatgtccagatacagggaaatgtgttcaaagcaagcagaagagcaagtgcaaaggccctgaagtgggaaggatttcaaatactctggaatatgcagaaggccagtgtgactagagttcatcgaagggtagaaagattagaacaaaacagtaagcaagagaggctttttaaaaagctagatccattaggcttcataataaggctccagcaagaaattttttcagaatgcaatggcagagccaaggatatagctttaagccaggagagtgatataatcggatttaaattttaaaagatcatctggccactgactgaagaatggatttgagggacaagggtagaaataggcaggccaattaggaggctgttttgatagactaggtgagaaggagggcgtgaaagggatggaaagatgtgagcagatctgaaataaaagagaaatttaacagacatttaccttgagtgagctatctgtgtacattttttacttctctgacaagcctctaagccaagctgtgtgtcttattcatctttgtattttcctacttctcttctggtagtcatgatgaaaacagagttcttcaaaattcttcctcttccagattttgcatctgtcaacaaaaacattttcttccctgcagaaagtagatgtttgtctctaattgtggggcctgaggtttgccatccacatttgctcttctgccaaagtcacgctgagtcgtggaatattttaattttttttaagttcagtttttacatctcattaaaaatgtgttggctgacatatttcagaaataaatatgcttaataatacctcatttaatttaaggctctcatttagaaaaaaacactttcaatgaaaagacttaaattgattaatcaagggattttttcgtattccttattagcagttataagactaatggtgatctaccgtaagccttccctttgcctaatgtggttagagctaccaaagagaaatcgttacaacctgtctaatatttataatggctattccaactgactgttgagaccattttagcaagaaaagaattaaaaacactaaacaagtcacatgtctcaattatgtttatgtatatgtggacaaataccctaaataaagatgaggctgtcatctttactacaaataatgtagcaatgatttatggtttgaacaatgacagaatgacagaactaatttgcaataggtcatatgagataaatttcaccatttttggttcatttactttgatttcagaattaccatttctgaagatggaaacctcagaatcatcaacgttactaaatcagacgctgggagttatacctgtatagccactaaccattttggaactgctagcagtactggaaacttggtagtgaaaggtaatggctaacccaaagaattcgaatatttatatatgtgtcctcgtgtctaataatgtaatctaccgaagtggcatcattcatattaatatgtacagataccactgtattgctaaattaattcatcacggcaaacatgatatgattaataattcttagaaaactgctggtaatgaatatgattgaaaggctatcttatttcagaatcatccaatacaattttgagaattatagccattgtatctcttatagtattgtaacgaatgttatcttcaatcctttaattaaatttctttcaagtctctatagatttgaaattcatgtctaggaacactattccaacaaattaaaaactcaagactcatgtactatttttagaaaacattgtttaaacaatgacattggtaatttttaagatagctgtcccatttattcagagatatggatatggcttattatactaatagaaggctttgatcacctctatgctttgccttagtcacccagccaaccttgtcagttttaaggaaataaaattcccatataccatagcctgggtgctttataatttttgtagcagaaagtcctttatgctcttagcaaagcacgtgagtgaaactatttcaatattagcttcatggcatgggctggaagtgctaagtaaccattgaaaaggagaaaatcttaatttacatttcatttgcatttctttcactttatatattgccctgtcataggatttttgagttgaagggatcttgacaatgatttgactgaagaagatgaggctcaggttggtggttctctcaaggtcacgagtagcaggagacctgaacccagatcctgattctgagttcttcttggtcctttatgctgcaccaggaaacaggaagcctttcctgtttctgagtaatttatacagatgggtcatatcatattatttccttcttgcccatttgtagttcccttggtgaagacagatgaaggcaaataaaaatatcaaaaaaaacaatttgcctttaatttaaagaagaaagctaaaaattacctaattaaatattttagggtcattagaagttggaaatgtactactcttttgggaagtctttttatcattaacatacttgaccatgcagatagaaaattggaagtccaagagttagaactaaatatatgtttagattgattacaactatttcagtctattaattacttcctcagagcactagcatcagtgtatgactgactgcttgttcactctgtttcataggcaaaggaaaaagaggttagataatatttgtaaagtgcagttctagctagaggtttttgctaatgtatgactgtcttggctaaaggaagtttagtaatcatttaggaccaagagagatctcaatgtttcagagctggttagacacagagctgggatctgttatagattatttgtgaattatggagatataagagaatattaggttgacatcttaaatcatagttaaaagacagggattcaagtcagagtgatctggatttgagtctcatttctaccacttaccagctcttagacaagacacttagcctgtgtggggataatagcagtgccagtctcatggagtcgctttgataactgtgaaaatccatgttaagtgattagtgtggtgcctggcacctaggaaatattaatagttgttttgtttataaacatgttttcataaaatgaggttgttctgatgactgtggtaatccatgctaagcgattaacagggtgtctggcacctaagaaatattagtatttgttttgttgtttatatattttcaaatggatatgcgtgtattctaaatcctgttgaaatgaacatttatgatatttccaccccaatagaataattagcatagagaagtgagcctataataaagaaatgactaagaatatgaaagattcaaaacagctaagcatagaaaccatatatatggtgtctcatattgttaaaagtagggtattttcacaggtaggaacaaggtatgttctgtattttattatcatccttcttataagtattggcttccttggctctcccaagagttggcagaaaggagaggcctctatttcccatcagagtttgcatcccagtgataccacaagccccaggacaaaaccgttcccaaccaactgtgcagatccctgctgctcatcttacactgaatcacgatgcaaagcctacaaatatatcagggattaaatacgttatagttgcctcatttttgtgtggttataaatattgctaagatagtaatttctacctattctaacaaacaaaataatttatttcttgccttctagtaaaatgtgaacaagtattcacccaagtaagtataggatatagttttaggcagtttacagttacaattttttaaaattttattaactatttgtttctttcaaggtatattaggagaacactagttttccactaacggcaataataacaacaatatttcaaaataaatttacgtaaagaagtgagtcggtacaaagaaaagtactaaatatgcattgttataggaggatatgcaaaaaatcatgaagatggtatatgtgaatgtctaaaactaggaaacatgacttgaggacaatttccaggagagttttagtggacttatagatgcagaattagtatgtcctgcctatgctagccacatgattcgctgaaacatgcacaacactttaaaaactgaaatttcctaataggtgagagaacgaggagggactgaggtaggaagagcctggcccagtacaaaaagaggaaggcagggatgtgtaggtatgagccatgaggttaagggatgatgtgcccaggtagcctgattgacaggtagaattcatgtgtttccaagcagagttatttctggcagtggctcctggttctgagctgcagttagtttctccacagaggtcctctgattcttatattcttcttctaggtgaggtgggggaaaaaagttttatttggccaatatgttctcaggagttaacaatcctgttactttagataaggtcagaagagatttgggggatcatttatctcccagtgtggttggttctcactcccattagcattaatgggaagtacgtgtgtctgcagaggggccatccacagtgcgaggtctccaagaaggacattaacataaactgagaaatataatttaaaaatctgccccataaagcacgatataggcagagaaaaccattctgaactccgcatgaactgtgccaagtcctgaatcccacatcaaaatgcttgagccctgcacctttagtgcaagtgtaacagcttagcccgaaatatgactgagcgctgtattttaattcaattttgagatctacaaagggactaatttatcagagaaggtgttctgtaaccttaaaatgtgcttgtattctttccgatttcctcatgtgtctgggattaaaacaccgtgaaggtcgggcgtcagaacatatcttttctaacctttttacaatagttctatcattaaccatgctttcaaaatccaattctctttctccctacccttgcccccatgtttcggagagaggctgaagatagtgtcaaacacagggtcagcaggtaggggaggagagggaggtggcacatctattccaccagatacaggaggtttagaataaacctctgacaagcaatcatcacatgaataaatattcagattctgcatgagcaggctcccaaactgcagaattctgacaggtgcccagggggctcttgattatcatcccatcatctgaattcctaaattttactggttttgtttttcaggctagttataatatacttgggatttggtttgctgtttcattttaagcaagaacagttcttaagtcaaaccctcaaatactcacagaaagcataatgttagacctttaaacaaaaatgtgcttttgtgatcattgacatcattaagaactctacagagggcagggtacatttatatgcaatattgtacttactaaatcatgtttatctctacagcagagttaaaggggtggtggtgggtggggattttgcatgacacagtgcctctgctatacaggtttcatatgacagatatttttaagtagcagtcctagagaagagcaatttagagtatttgtttggatgtagttcaacaagataactatgttaatagcaaccctcactcctattgattatctccaggactcaaaatgtagggcagtatgctgtggatgctgttaacatagtcatcgtgctgaactacatccaaactgaccttgagcaattttgcaactggtggttccagactatactttgggaaacactgtcctacaccaaagaacttcgtacatgcatgccacctagcaagtgacagttcagtagagtgcatattagaagtgcagatctcctgggcctcactcctaccctaacaaatctaactcctagggaggaggcctggaaaaacctacatttaaaataaataccccaattgatccttatacacatcagagtttagaacattgcattttcaggggtttcacactatgctctgtgggccaaatccatacctgttttatataccccaggggctaagcatggttttcacatgttagctggttgagaaaaaaaccaaaagaacaataatatttttgggcatgaaacttttatgaaattcatcttttagtgtccataaataaagttttgttgtcacatagccatgtcatttttttacatattaactaaggttgctcttgccttacaacagcaaagttgagtaattatgacagagactgtgtaatttttttttttttttgagatggagtttccctgttgttgcccaggctagagtgcaatggtgagatctcagctcactgcaacctttgcctcccgggctcaagcgattctcctgcctcagtctccctagtagctgggattacaagcagatgccacgacgcccagctaatttttgtattttttagtagagacagggtttcaccatgttggtcaaggctggtttcgaactcctgacctcagatgatctgcccgcctcggcctcccaaagtgttgggattacaggcatgagccactgcgccccccgagactgtgtaatatataagtacctatataatatcctcaactttgccacttctgcaaaaccttaaatatttactagtaagtccttcacagaaaagaaaaatacttatcctctctttgataactttttctcttcctcagatcttcaaaattctgtccaaggtatagtctggccaagctatacacaacttttcttgtacccctgctgatcttgcatgctggaaatttccacatgtccttgagtctgattattagctggaagtggtagggagttttctttcccaggaccttagcctcaccccagtatccaaacagttgactttagaacttggatacgagttgaaaatccagaggagagataataaatcattgattgagagggaggaggaaaattacttggcagacactggaacaataattcaatttgattctccagcatgtggggaggattcacacagctggaaccagaatagtaagctaagaagaccctaaagtaagaagcacatgacctggtgtttttttaaaacacttctctcttcctaaacctcccaccgtcaccagcctaaatcagcagaactgttccacctttacctcataattctcagactgcatgttcttcctctaatagcaatttttttttattttgaaattgactatataaagttttaccctaattctgtctggattttaaaagagttcttttggcttttctgtttatttaaatgtctaaattcagtgcatagaattacttttataataagaaaaaataaatttatactttaagtagctttaatagaaaagaagtctttagtggaaattgactaagatcacagatacacgtaacaagaaattattttgtattttcattcttcaaccctacaagccgaaaaggttcctgtggtttagctgagcatttaacggattcctttattgccagaaagagtgctcattgttcaccccatagaaagtttatttatgtttaaatcaacagattttttcatatatatatatatatatatgtgtgtatatatatatttgtaccagcaccaaagagtatctacagcattactattgcgcactatataaaattcttctgttttaactgtaggacattgggaaatatcaacctttccatgcatagcataatagacgcaataaagtagagtcttttcagttggaactttattttgcaaatgagtttgaagcagcccaatcttctatgtaaaactgttcaaggctttatacagatttgacaggggatcaatcagaaatcagtaacatacaatgacggttggctgctaacacacaacaaaagcttttaacattggtcccttataactgaatacatttcaacccaattagatatcttccactggaaccaattatttctgggtgataattaagggtatttctaataggattaacacaaattgtgaccctaggcatctagagtaggaaggaaaagtttgtcattagaagtgctaaatgctaattatggtaggtccctcagtagaagaacatctggccagaacatttcaatactagatcctgttagatctgagatctgtcaccctggagttggtaccagctatggtaggagaatcttaaaagaagggtaggtaattgtgcatcttgttcttcctgtgttcacaaagcgtgtgacataacctggaaatctgatgaaacagggtgtgattatttcctctgacattcttatggacatgtgtgagagccacgtagattgagcaaataacatgcctttggcgatatcaatcatgagtagaatgattccccttttgtccaaatctctctgtaaaaaccttctctccttttgtaatgctgattgcataccatgacagtctgccctgactccagcctgcccatcacttctccatccttggtctagagggaagatgtaattccttaactgttacatttctctatgccaactctgtctttcgtagcaaagcctctatgctgaagacaggcctcgtatttttgcttttggcataaaagacactctgtgggtcaagaagcttgtgtggtaacatcacctcattaataatcagggaaaggcaatgtaagcatctgtgtggtgtgatttttttacatatgagactggcaaaagagaaacatctaacagtaccttttgttggtgactatgtgaggaaaatggtactcacacactctcagtagggatagaaattgcaatagatactgtggagagcaagtaaaattgagaaagtgcaatctccatggcccagcaattccattttctgggcatttaacctagtgggattcacacgtgttctgaggcagacttgcaaaggtgttccttgtgttgttgtttgtaatgaaaagaaaatacaaggaaattaaagaataatacatatggtatcattttatttaatatattgtatgattaaatataaaattagtaatataaaataataccttataatgtttgcatacagaatacacatgcggcataagccctaactcagtatttggagggaggatgcctggagtgagattatgtgaaaggactttagctgtattggtaatatctgtttgggtaaatttttaatatatattcatggggggaaaaaggctggaggtacatgaaaatgtgttaaagccttctaattctggaagagggaatatgagcacatattggtaaatttttgttgtagttttatatgtaaaatatttcaaattaaaaagaatacctcaggtcagaatcctacatggtcagatattgcaggcaaagccatccagacaggaggtctgttttttcagttctctctcagatattgtagaagagacaccttttacctggtgatatttaacccatcccatacaaataatttctttcttgtaaggaaaaaactctcctataaaatgaattaatgaattcttttgtaatgaatatttactaatcagaataaacaaaacaaacaaacaaaaaaggcaaacagaatatgactctttggcttcattatatgtgaagcacataattaatttcttttccagcaattcaaagagacttatgttatactgattcagtttaattgaacttattaccacaagaagataataagaaatatattgaagctatccatctggcttgcattgaaaacctcacatgtttcattcttcatgactgtcataggccatactaattgcctcatttcagctgttttataatcagtatgatttagctatgaatgcgataaaattcttactccagaggaagttgatattaaaaagcatagatctctcacctagctctgctaccacttctgaactcatcctcagcattattacagttatatatttttgaaatacataaataaaaatctatctttttctcgtgcatatctttttaaagtacatctgtcatcttccttctgtcatcctgccatagagctattcctttactgaaggaaagaaatggtttatgttaagcttttcagttcattaaatgtttaaatctcaaggtaggttgttttcaaactatggagtctttaaaaataatttccatagctgaaatggagtttaaatggctaattgtgtaataaataaagagaaaagaaaacttaggcacttttaccttctgtctctaaacatctgaacttcctgtggcttgagaatgatgctttgtcatgtagactggttttatgtgcacatgatctctcagaagaagacgagtttgtggtatgtctatgtgtatgttttaaatcatctgtctccttgtatgttagaggtggtcccatggggggagccaacagttggtcccaggtctgaaagggaaagcttggtttcttataaagcttgaatcagaaaggagacgtgtcagaataattcatgagtgactctccccttcctgttttggcatttgttttctgtgccagaggcaggaggagtataactctcaaagaggcagtcctaccaaatcacgactgaatttctttggctgtcgcaggcaatcaaatttaagaaaactgcccaaaagactttaggcctttaggttaaatacagaatctgaccaagatgaaagcaagttaattaacattttcatcatctctctctgatttactgtagaagatccatttctaaaaagttaaaatggttgtctcttttatgtatccatttgaggaggtgaaagtaggttcctggttatgggagaggaaatgtaagcagaacatttagagttaacagtggctttttgcttggccttctagcaggtctataatcagtgtgcaaaagtgcaagacataattaagtgaagattagcaacattgctttgaagatttcccaaactggaaaacataccaactgtcatcttattaactttttccccttttctctctcttcaaaagtagaactgcttataaatgtaagtaaagcttggattctacctagaagaggaggatccaaagggtcaaatcagaactgccttctcctccatgtatactttaataagcctggcccacatctctcctgatagaacatgtatctgcctccattggctttgtccacagcatgggtagaacacctggtcactgtgcaatttgtaccaacacttcaacttcttcatgtgtaagacaaaggaaattaaattataatgaccagtatagttgatgaagggacactctgatgcagtccaaatatgagggaatagtcaaaaggtacaaaagacaaaactgtctcctccctgtaggccattgtgagccgtagaccacaagcatcagaatcacgtaggagtttttaaataaatgcatattcctggaccctacctctgacctgcagaaccagaatctccagggatgagacccaggaattttcattttcaacaagttcttcagggaatgcctacactcaacaaagcctgcaaacttaggagctcaacctttaggagtagatactgataaacaaagacacagagctgtgttcaaagtacagaaggaacacaaagggaggcaaaactaactaagaggtaaaggtgacaattgaacagggaattgaaatatgagtaagagtctaccagattaaaaaaaaaagtcaaggtaatcccaggaaaaagaaatgtatctaatggccccagtacatgaaggctcctagcatattcagggaaaatacagtggaaaagtgaggggaacacacccatagctattgctcatatttcaggaactgtggaaaataggcaaatactttgattccctttttaatggaaataaaacagatttcatgaactgtagctaagtgacatgacgccaacttcagtagaaattttgcttcttctaagagacattagaatgaaaagtagttatcaccagcatatgattttttaaaattatgttgtaattatattatttgtagaaatattagcaaaaagataatctcatcattcagagagatccacataaatattttttatattttcttctagaattacatccaggctgtattcaatccatatctacatctgtatcttaactgtgtatgtatctgttctcagatctgtaaataaatatccttatcacaaaaagatcatactgtatacactgtttgtaacttcttttttcattagtatctttctaccagcatagattattttgaacaataaataaggactagcctggtttctttatgaatatgtttctatctcctgctcctcaaaatagcatcagcaaaacaaaacaaaaagaacaactcttgtaatatctatgtggggaagatagaagaatctgggggatgtttaggaggattgtttcacatgtttcaccctgaaagtgttggtttggggattgtcttagtccacttgtgctgctataataaaataccatagactgggtaacttgtgaacaatagcagcttctttctcatggctctcggggctgggaagtccaagatcaaggtgctggcaggtttggggtctagggaggggccaattgtcagttcctagatggcaccttgaatactgcatcttccagaggggaggaacactgtgtccagaggggaggaacatggctaatttgtcctgacatggcagagaggatggaacagcaaaagaagacaaactccccacacgaaggtcttttataatgacacctaacctcattcatgactcagtcacctcctaaaagccgtacttcttaatagtgttgcattaaggattatgtttcaacatgaattttggaagggacacaaacattcaaaccatagaagggatttatgtcaatgggggaatgaaatccctagccattctctgccctttcctcaaacttttcctattgaaatttcttatcagttgacacatgctgttactgataacatgctgagtacattctctgatcacatgaatcattagggaataaactaaatatcagaagtagtattcaaaattagtttgaaagataatcatgtgaaccaagtgtaacaagatacatcttaatagtgataaaatataaagatttgcatttttcttcaaaactcaggatgagagagccaaattttagtgtcaggttgtgataggtcttagatgactataacatcatttatgagtctacaatatatatactctttaaaaaaaaaattaaatctagaacataatagtgtccaaaacaagagaggggggaaatatagagatctactgataaaaatacaactggaagaggattgcttttaagatagacattaaaatttgaaatcaccttaaagagtgacaactgggatgataggaacagctgtagaaactgaggctgggtaatccaaggaagagaagacttatagagggtgggaggggaggggtggtcagtgttttcaaacatttaaagagatatcaaactctatgtgacatcagagggcagtaccataagagatgagcaggaactgctggagcagaggatattacttacgtttgataaaaggaaaattttcaaacaattaggccattggcctattatgtatgacattcatttccagactagacatctactctagggaaatatggcagaaagaattcatgtatcagatacaagtgtgtggtttgagtagcctgtagggtcattttctattcatcttagcgttctcagggtctgccctaagtaaatgttgactcatatatcccacccaactctgaaatgttatcattctctgattttatagcttggaaaacttacttctgccctaatgtgcttctactccagagcaaaagcatacccctaggttgaattctgtcacactgactttgttttcttactgtagagtctttctttctttcttttttttttttttttgctttcaatgtgaatttatccataatcagcaatgcagtatgggttgaaaaggttattccgctaattttgagtaatatattctcaagtaacctattctcaaaatagagtccaataaaagtatccgttttctatttaatcatatgttgggatttgaaggggttcaataaacagtaccttgttcagtgcctgagttttgaaacacttgagaagtaagttgaggcagttgggcagatgaaaatcaaatgtcagctttgctagtgataaaggggaatgtggctcagggacatagcaataatgggcttcctaacactgaactccaaattaagcagacttttaccgctacacaacctcaagtctctctcactacgaaaagaaaaataaggagtggaggatcaacgcaataggtgtacatccttcactcttccaggagaaagaatggcactgagccaagaattcctcattgttttttcccagatgcatcactggataaggagtgagtaagaggaaaaaagaggacaggcatgttaggaaacatcaggtgtgtttaaatgtcagctatagaccaagggttacaaactggtagctctcatggctaatttgacttgaacccacagacttgtattgtttggctgtcagagtgtttaaaccttttaaattagaatgcctttagacagggggcatgtattctctaaactgaccccagacctaattattccgtattatcttatagctctaaatcacatgcttaggatactgccacatcctctgtaagcatttgacacgcagtattaagtgggtctcattgctctatgaaaaaaagccagctcttgattatttccaatttttaaattattaagtagatgcaaattgaccatgatggggatttgagaagacgactactagagaagagaatgtttcaaatctttctatttataatgctgtacatgattctacactgaatctgcatttcactcccatatctataccagaaggttatcagtggaagagaaattcagttatctgaatggacatgatcttctcaggagcagtcagtggttaattgggacaagaaaacacaagtcattatcattgagaaatctgaagcaaattgaggcaggttgtcacctttcaccaggaaacaaattagccctgtctttaaaaagacttctttctctctctgctgactggggattcctgtcaactgccaatgaaatagggagagtgtagattaatggtactgtaacagtggccatgaaacaaccataaagccgttttctaatttttatgaatatttttaattgattcgaccagtgtgtttgaatgacaaaatttgtgctaagcttcagctccagaaaatcagggtgccatcttccagctgaaatcagtaggtgcaccagtctgtttggggaaagttctgtgtataaagaaaaagccataaaataccgacaaagtagctcttcctcttggctaatttaccttcatgaactccttgccaactagggacgaatataattcaggtttagctcaaaaaagagagaaacagagatagagagagagagaaataataaaatagtaggtaacatcctgagttataagggttgcaagtaggataaaacttgagatatgacctactttttctacaatttgtgaatatgggaatcattgcagtctaatgcaaagaacagtgaactgaggtcctgtacatctgggggctggttcccagattccagttttctcacctgtaaaatgaagagcctttaatcgagaaaatgaagtccccttctaattctaaagttctctgatttgatgaagaagaagttggaataaagcattaaaacattccaatttcaaatttatttgttaacagtaacaacaaatttatccagagatattctaactcaggcacccccaaaaatgagatgaaatttttcatgtgcaagagatttctattttatgaacatttattttacatgcatcaggttatggtcactcaaggaaagagaaaaattaccatttaaatcgtgtgggcagttttaccaaccagctcatccacgaatggtcatgcgatgaggacctgaaaggacattggactcggtttgcctcgatcttcatatacctgtcaaaatgtgatgatcttgccaggctgaatagaactgatgacattgattttacacagtatggccaccaaacacaagcaagccacttcaaatggctcatagagaaagggctagagagaaaactggttcatttgaacagcatattgattccaaggtggtgccttcctgggagacttctaagggcagttttcagtatataaaatgttttgttttagatactgactttaaaactgagccatgtgtagatgtatcagaaggcaaggaaaacttgtatacaaatgtccatagaagcattattcataatagccacagtgaaatcaacccaaatgcccatcagctgatgaatggataaaccaaatgtggtgtatccatacaatggactattattcagtcattaaaagaaatgaagtactgatacatgctattgatatgtggatgaaccttgaaaatatgatgctaagtgaaagaagccagacacaaaaggccacatactatatgattccatttctatgaaattcccagaataggaaaatttatagaaacagaaagtagattcgtagctgccaggggattcaaggaggcaagaattaggactgactcctaataagtacagggcttcttttggggataatggaaatattctggaattagatagtagtcatggttgcaccaaaaaaaaaaaaaaaaaaaaaaaaaaaaaacaaaaaaaccccactgaattgtatacttcttaaatgtttatttatttatttttgagacagagtcttgttctgtcacccaggctggagtgcagtagcatgatcatagctcactgcagccttgacctcctgggcacaagcaatccttccacctcagcccactaggtagctgggattacaggcgcacgccagcacgccaccaagccctactaatttttctgtattttttgtagagacagggtttcgccatattgcccaggctagtctagaactcctgggctcaagtgattctcccgtctcagcctcccaaagctgtaggattacaggtgtgagccaccatgcccggcctgaagcgtatactttaaaaaggtgaattttatgttatatgtattatatcttcaattataaaaggaaaaaataagtaatgatctattttgcacacttaaaaaaaaaaagaatgaatgaagacaaaaaggaagtaatgaagcaaattcatcagctgtgatctccagatgtcctagatgtcctagagcttgacatattcttaggggtcaccagcttttctcctctcagttactttggtgtttttcctgatccagcctctactctgataacagccctccactctattcctagaaaacactgttggagaatagtccccccatcagtcttccacccactgtagctctacaaaatctgggcacccttcctctctatttctgtgacaccgtacctgatatttaaggcagagttactggacagagaaggtctctgacagatccattacagtccatctgttcccttttcttctaatgtattatagagggaagaatataggctttgaagatagacaaatcaggttctaatctcgacattaccacctataagctgttgaaagtgcgtttgtaaaatttatataatagtacctatttcataggatagttgggaagactaaattagatgatgttttaaccttaatcagcacacaccagcactcaaatagttactctcttctcttgctgtactgttcacagcccaccaatgagaaccccagtgtctggccaaatggccgcattctgctaacatcttgtctatgccattgtgtacttggcttcacaataaagcctttcagacccactggggcagtggtcctgtacctgtagctcttcaggggtcagctgggtggctctatccccatgcctttgggtggaggctgcctggtcggtggaagcaagttgaagctccttcttttaaaattcaagaggcagccctgatgatctctgaatcacctttagcgtcattcttcccttgtcttggaaataagcacacattcactgccaaatagctttatagtcttctataaaatcgaaaaattctggtagcccttcttcagttcttcccatcttcttcctcttcagtttaaattggaagttttcctgctggggtggctgattaagtcagtgattcacaccgaggctaatctccttacccaaaaatcacttggccacatcctttgtattctcttcagaaagtgcttttccctttttatttttgtctttgcaatatggataggctgagatttttttcaaatgtttaatttctacttcctttttgcttactaattctgtcttctgatcatttctctcttctcacattttgctataagcagtcaggaggaaccaagctactccaaactttgcttagaaatctcttcagctaaatatccagtgtcatcacttgcaaattctccctgccagaaaacactagaacacaaacacaattcagccaaattatttgccactttttaacaaggatccccgtttccgcagcgtaagcagaaatttatttctcacagttctggaggccgtggtctagagagttcaagaccaaggcactggcagatccagggtctggctagggcctgcctcctggtttggaaatggtcatttaccactgtatccttacgtggcagtaagagaactagccggctttctttcctcttcttataagggcactaattccattcatgagggatctaccctcatgacctaattatttcccaaagaccccacctcctgataccatcacattgggattagagtttcaacattggaatttgggggttggggaaacaaacattagtcaattgcactctatctcagcacactgtgtagaattttttttttttttttgagacggattctcactgtgtcgcccaggctggagtgcagtggcacgatctcggctcactgccagctctgcctcccaggttcacgccattctcgtgcctcagcctcccaagtagctgggactacaggcgcccacccccacgctcggctaatttttttttgcatttttagtagagacggggtttcaggatggtcttgatctcctgaccttgtgatccgcccgcctcggcctcccaaggtgctgggattacaggcatgagccaccgcgcccagcccacgctgtgtagatttttaataatacttttgttatctaaacgtacttttggttttggttatttgaacttcatgtcaccctcatgggaacataaacttcacgatcagaacactcacgtatactcatagtctttgacacgtctggcccatattaggtgctctgtaacaatttattgaatggatggaagaatgaattaatgaaaggaccacatgaccaggtctccttttgcagtgcattggaatcatcctatctcagagttgattcataaattgccccaactagaaggtccctttgcgatttttgaaagagatagtgatcatctcttccagctcattctttttgcaaaggatactagaaagggaaaattttatattcaagctaaggcccaataattaggccttttactataccttattgtctcacagaggaacttagcaaattcttgttattcaagtaactactgagcaaattagtaagcagcagaccaaggaaaaacagaggtcgtcaatggggcatagtgaaagggacatgggctttggtgtctgccaggcccgatttcatatactaactccagacgttcttagcagctctataccatggaacaattaatctctagaagtttccgtttttcctccttaaaatgggaggtccaacctgttataagaattagaattttctctgtcaaacatctaagagctcctggtgttgagtgtgtacctttaactgataatcaatatcattgtgtttgtattccttttgctacctccccgcgccatcaactccactaccatttatccaagagcaatgtctccaagtgcttaactgtgtgtctcactgtgtagttccctgaaaacataccaaatcccagcagtgtttttgtagcagcactgaagtctgagaaattagtcactctcctcctagaaaaagtaaatcattactgtatatctacttcttatatttatgttgtttactattgtgcatgtattatagaacccacaaatcaatgctctcagcagacaaaactgttcaaatctgcagcacgtcttgttgtgtactaggtatttgacaaaacagtatatatctgtcctgaattctgttttctgaaggatggtggtgtgagcactggagtctgtgattgatttctgagtaacttgtactttatcaaggaatagatgtgatttctcatgtatctgattaaccctccctgtaagattaccatcatttctataatgccagtggattattctgtgcttggaaagatgtatatcagatcattttaatcaatagcctacaaaaggtgtcacctggctctgcctgtggttatctataatatctcacccaaagggtgttgtcatttttcaaataacctgtttaacttaaagcacctaggaaatgaagttgcctttattttgaaacagtatgcagaacaatatgttaggtgaataaaatgtatgcttgttttctgcacgttaccctattaaaaagagagaataccagtgtggtaaaatatccacttatccatctccatcacacaagactggcttggtaacccatagattggtatgggagcaagataaaagtagggtatgcaatagattctgtgctggcatagcaaaatgggagcaatgaggaagtgacactgggctatcatataatcttttatcccaattagaataaatggggtgctgcagataggctggaacaacagagataaacccaagaccatcctgggcaagcaaggacacatgtcaacaataaagtcataccctgttttgtaatttaggaaactttctcatgatgttgagtaactgggacatttgggattaatgatgtatctgtgatgtactcctctgttggattccctgagaaaaatcttttgagatataaactaatcattgcttactattcagccatgtagagaatgtgtgtttccatacttaagataatgagtcctactaagagagaagaggtattaattcttgggagggataattttatatcaagtttagacagttttcagtctgcactaagctccttttttatggccagtttaggaaaaatgctaatgcctcgtatccagacctgtttggagatagagcaagtcaagcagaaaaacgccattctcctaaatgagcgttaggccacagaacacgaaatctgtcaggcagcattttacctggcatggatccgccaaagaaaacaaacaaatcagagttggattttttaagactaaataacagcaagccaaagaaagagcatttacactgaaaaaactgtaaaggttgacaacatcctcaactcattaaatatgatggggaagagtaaaatatgtagcacttttgctccttagtgtgggcttttaagcctctccttcaatcgtgatttcactacttcgtctctaagctatagattctgcctttgcaaaaagagaatacccacctccctaagtcgttccgtgtctaagaaaggtaacattatgcagagcattaaacatgtaacctgacacagagacactctacataataataggtcatttcccttctcaaacgacccagatttctagaggcaactagctatagcttgatgcaaaagtgttgcagtttttaccattacttttaatgcaatttaaaacgcaactacttttgcaccaacctaatataataggaatagacaacagcagtagcaggcattcgggtttcccattgtcctcggcattctagggcaaaccaccaagatctaataagctgtgagattccaaaagaagggcgccaaaccttgggctgcacggcttcaaacttcgtcattacagaatcaccagcgtctttcttggtatgatctgcgggctagaggacaagcctggtgttattagcacagtgagcaagtggcaagagcaccacctccggagccacaattagggaagtaccatgccttgccctggcatgactggagagtaggggccaatgttagactataagagttgactaggattgattgccataaacagtgggccatggttactttcctcggagcattgcagagagcctctttctctgggaggccagcctacaggagatcagtcttagacaagttaacctttacctttcaattatcatggcttaaattttcaggaactctcttctagtatctgaatgttccttatttgtagcacccttttcttgtttatgcaaataaacaagaaacacccttttcttgctactgtcaattcaatatctaatatttctctgaaaataataatgacagaatttcttttttttttgagatggagtcttgctctgtcgcccaggctggagtgcagtggcgcgatctcagctcactgcaagctccgccccccgggttcccgccattctcctgcctcagcttcccgagtagctgggactacaggcgcccgccaccacgcccggctaattttttgtatttttagtagagacggggtttcaccgtgttagccaggatggtctcgatctcctgacctcgtgatctgccctcctcggcctcccatagtgctgggattacaggcgtgagccaccgcgcccggccagcatttctttttgcttgccttgaaattgatcttttgtgttagttgtcctcacatgtctattgactcacagttgttggcccatatttaagagtgtggcacgaaaaagcctatgtgaagccgtgaacatgtagatgaagttcattgactaagaactgggccatttccttgtggaactccccatacccacattaatatttcggtgtttccttttcggctgatcgctacctagagaaagaatatctagtacctagtctcatttggaagaacacagaactcaacagcagtgtcctgggagcctccttggggaaggagactgagaatctcagcttcactgtatgaacactcactaaatccctgctatcctcagttcaacctggtgtcctctggcccagagacctacctctgtattacctgctcagaaagtaaaatcccagaatacttctgggatggggagggttagtcacctggatgcatggaataagggagagcaaatagggacctaattgattttaaacagcatcttccagtgctctgttacctgacttcaagtaatacccgaattcccaaatctttgggcatttttctatagagtaagtcagactgtttcttgtctttccccactgccagtttaggattcagggtttcttatctgctaatcatccagttgctttccagtattttaacagtaatacctcccaaccattctctctgtctttataggcttatgccattaaaaaaaaaaaaaaaaaatccttgtactactgtttaaaaaagttttagaaggttcctaggactctaaaaggatcattgtgacgaagaaatggataatttaaggaagccagcacaatgcctgacacataattgtagtgattatttttgttattttgttaatattcaatccttgtaaaatcatccaagtttataaattatgtactatatagccaaacagcatggacgaggagggcgctgtgaaattaagacctacgtcgttcaccttcccagtggtgtcaggtcatctctacaaccatgagcttttagtatggttagttcccattccatttcatttagaataaccttgtaaaagaaacagggattgggtgtgagtgacacctaaccactaacatgataagcattctaaatctatgttcagcatcatgtaagtacaccctcattgaaatgcagatctccactactggtaattccacacactcctattgaagaaagaattgctcctctgaagtttgctaccccatcctctcacgtttatcacttctgcaaagtcatgcagcatgcctcaggtgaccctgtgaggtaagcaatcttgcactgtatgtgggcatttgcgctgatcttcccagaagcaacccttagtccttgcataatttctagcctcaggagaattataagatagaagacaagtgggggaagaaaaggtttaaaaagattctgtgttctttaaagccagatacttctcagctaagcttttctcagacctttcatgtccctcaataaagtatatttttggctatgccccataaactactccaataatccattaagatagctgtagaaatcagcatagcaaactatcagtgagctggtttagttattcaccggttattaatcttctcagctcagggtcatattgtcctgtcttcagcatttttcacagtgtctgatgatgttcagagagttaatggaggtcctgaaatgtggatacaacaagcatgataatcccttgacttgatgtcattctagggatcgttttcaaactttgtgtgttgccctggcaaatgagcaagaaggcacctgtgtcacttatctggatgtttgtacactgttctggcaaataaatgtctatgtacaatgataatttccttatgatactttcactagcaacaacttgttttgagcatttgttaccagttttagtagctgtcatttttgtttcttctttagcttccttgtaaagtcgaggcacattttgtcctgacttagagtcgcgatatttctttggagattcatgtgagcgtcttcctctcactaaattttcctctccccgccccagtctctgcatgtttggagaagttatcttcctctgaagcttcctgcacttaaaacagacccaggcacaagagacttccatgatgatgatggtgatgatgacagtgatgatgaggatgaggatgaggatggtaatgatatctttattcaaacactgaaaccattcatcatgttatatgcaaccacaggaatattacaagttaagaaacaaattaactgacttacaagtcaaataactttcccacaatcagtcaactagtaaggggcagagctaaaatttgcatccagatttttctgacttcaaaactcagtttcttagctacttccagtctgtaagagcagctttctgtctagaatctgtacaccctcaccacaagaatctagatagctggttttcctttggatctgcatggtacaggcatctatctttacacctggaagaggttcttttacttaggatgtctgtattcaacaaaatatcagttgagatcacgtagggcattcttgacctttgcaaggattttggcatttactctgaggtaaacgtggaggcatctttgtttctgtcacattcttagtaatagctagcattttttgagcactttttatgtagcaagctctattcttgtttgtttgatcggtttggttttttgtttttgtttttgtttttgagacacagtctcacactgttgcccgggctggagtgcaatggcgtgatctcggctcactgcaacctctgtctcctgggttcatgcagttctcctgcctcaacctcccaagtagctgggattacagatgcacaccaccacacccagctaattttttgtatttttagtagagacagggtttcactatgttggccagacttctattctcaaaactttgcattggctgggcgccgtggctcacgcctgtaatcccagcactttgggaggcggaggcgggcagatcacctgaggtcaggagtttgagatcagcctggccaatatggtaaaaccccatctctactaaaaatacaaaattagccaggcatggtggtgcatgcctgtaatcccagctactcaggaagctgaggcgagagaattgcttgaaactgggaggcagaagttgctgtgagccgagactgtgccgttgcactccagcccgggcaacaagagcgaaattccatctaaaaaataaaaaaataaaaaaaaccctttgtattaattcaccttagaacatcaccctcttcttactctcgaaataagtgtctctttttcctttcttccccgtgcaaatctttggcatcaatagtaatggtaataatagtatctcatactctgtagctctttatgttttatgaagcatgttaaaatccattaactcattttgaatttcatagtcatcctgggatgccaaataccatctcctccaaattatagataagaaaactacagctcagagacgtcgaatgacttgctggtggtttcatgcctaatcagtgctgtatggccaaacctagaaactaggcttttagacactaaattgagtgttttatatatttcatcatgatgacatgtttagcaaaagctaggttagtatcagagagtcagtaagagaaagtcctttactccctgagaagacatccagcaactatttctgagatgagctctagacctgggctgatttccagtgaacggagtcctgcttattactggtgctccagcattgtttgggagctcctgccatgggaaaatagcagggtatcctattgaccgccagggtgcccaagtgaacattgcatcctgcatgaaaagtgccctccgggattgtaaaaagtgtcaggtcctgttatggtaactaaatgcaagataacctttctgtggaaagcaagcatatgatggataagaaatgattttgtaaactatggaatgatctacaaatgcaaaataccatatgccttgtacatcttgcctgcttgagtaaatgaatgatttttcttatgtatctctctgtgaatattggtttattcgatgctgcagcagtttgcaaactctgttcactcttgcactgcagcccagagacacaccctagggagttggcatgtgtcatacaaataatgtgtacctatttgttataacctaggcttgggtcttgcctcactatctttcctaccaatactgagctattagattctaatggataatctaggaagtgaatacattcctgtaaactttaacaaattttattgaggaacagacatttaaatgtacacacacacacacacacacacacacacacacacacacacccctaggggttttgtttgttttaattcaagaaactaacacgtttgtggaatgaggaagtcattaatgttttttgactaaccaagacctagccaaaaatctatttctctttctgcccttaatctctttctgaagtatcctgccaatttttaatgctgaccgtttctcaatactttcagtctgtagtagtactagagtgcttcacttatcactgtggcaaaacctacttgtcattttagagaacagtaaatgtggatttggaaaatgtgggactttgggtcacgtcagaactctgacttaaatttcaggcaccctttagttggaagtggcaagatacagcttatctgcaaatgactgtaattacaaagatagagcttgcccaacaaagggtttctattttaatatcataaaaaccaaaaggtggaatggtgctccacaaaagactgccttttcactttctaaaaattcttttctggctctgtgtactccacttggtgtgaatgtcatttattagcatgtgatgtctttgtggagtagaggattctgccgctctctgcttgtctgtcttgctctgtttctctgcattttcatctccttttccttgtctcttggctttaacattctttccacctccattaccctttatattagattagatctaacttttaaattatttgatgtatctttaaattttgtgttccctgtacctaatttaaaagacatgaaaagttgtaaacatctctctgaaaataaactaaattaagttgctttatacttgcgtgaccctcgattggttttttttttttttttttctctttgggtcagcaactctcaatagaaaagtttccttatctctagtgtggaagattggactaaatgtccagtgaccttcaaacctgctccagagagtagttcttccttacaagagtgagttttccaatgatttgcctctttctctccaaaatgaaaaacagtaacaaagtcttaattcagggctcttcagattttcattctccctcctttaaatttcactgaatgtgtatataggtctcactatgaagcaagcaatgcagcaggaagaagagtctcttttagttaaactcataatgccttacctagctgcacacaaagggggcatttcaacaattgcaggggacctaatatctattaatagttgcccattctgaagggtttcaggaaaaagttcacttagaattacagacaagtcctcaaacaagctagtcagtggtggaccagactgttgggggtgggggagggaggattgtttaaggttttgttttgcagaaagcttcatcaatcaatcctatctacatcaaataaagagagggtagctaatattgtctaccaagatattaataccttctattttaagcttcatatgctcctcggtgacctcatctcaaatctataagcaaacaaagaagtactgctttagaatatgcgaattattgcttctttcccaagatgcagtccttaaacagaggaatctgaaaacatgtagaaaattgctgacaggagcaggttaaacagaaaaagagggacactctccttctgctgaggtttcagcaccatctactgtccagaatattaatccttccccacattgcactgtgtgtgaatggcacttggtttttcttttgcatgtaatcacaatggaaggcattgtctttggaattcattgtccttgcctcaaggtgtacatttcctttcttttatagtttaagtaaatattcgcttactttttatcagtagatgcagcccgatgcccagcagatgcaatcacacattcctttaatcagcaaagatcttattatgccattcttacacattgactatgatgaaatttactgtatttcactgatactaatgggattttggggggactcttttgctcagtgagtcataagggagagttacttatgtgcagtcactgaaataaacagaaaacattctaattattatttgatgaaaatgtttctccgtgggtaaaagatatctgtggttcccatttatgattcttttttatcttccatcacagtcaaaggcacgccatagagtgattttaattataccttgactcgaagatacaatgtatttaatttgtcattgacagtagtcttttcctagtcctttcagattgtcatttcttttgaatcgtaaagaaagcttcaaaaagaaaatgtgagagggcaaatttaacatataccccccttccctcttctgttattacttgctattttgcttgaggaagtattcttattcatagtgggaagcttaggcacctgcagaaaattctttgcatttagaaagacttcccagatgagaaaccctgctactgaagcatggcacaaatccagaccccggaggtttgctttccctggtcatgggtaaaaataaaaacaaacaagttgacggtgaatgactttaagacagattatatcttgcttattaaaaacaaagaaacaaaaacctccttattaatcgttgtgaccaagttagagacttgggaggcaaccaagagcattcgagcatcattagaaccgtcttcataattaaataggtgctttatgctacacattttgaccaggcagatctaataactttgattaccacctgactgattgtttcccaagtacctatacttggccaccctcaattggcttgtgcatagtagtttccatttgtggcagtcaagcttattaaacagctctgctttgcgattttcccccagtccttgaaaatagatcagtaagcattccactcaggggcgatttgtaaattgctttacacaaggctccagtttgtgctcacgccgactggggtcaaaatttgccttgtgttttcttctgatgtcatttgtcaagttgcacacgttgttccgagaaccaggtcacaatactatgtggctgtgcctctcggtatgaatcgatgaaaaaccttgacttgtgaacgtgccctatgctacttctgtgttttcttctgccacctaaaagggcagacttccttgtcttcagccaaaatacacttattgttctttttccaattggttcctcttcccttcttcttaaagcaaagtcacattttaattatgttaacaaaaagagaggtaagataaataggggtgctattgagagaactagcctatgttttaaaactgtaaaaattctcaattcacagacataattcctcaatggaaaacaaatcttagagaaaagtaaatgtgtctaaaagagatcaaatgtgtaaaggattttccaaagagcaaaattataagcaaagtagacacttaggaacaaactacatatatagatgtctgatattatgtgagtgatgataacctgaacagattttatttcatcaggatatttcggcagttaaagcttacccctaaaatcaggacttggagctgagctcccttccaggaacctggggcagacaaaaaaaattctacccagatttgagacctttaaaggacatttacctgtggccagaatgggcagcaaggccaccccccaaaaagagtcagacctgtacagtattgggtgcaatgtcctttattttgctatgccgtgaagtgcaaactgcacatttttcacataacctgatacaggcctttacagccacacaacagggagaagtgggtgctcacgaggaagaaaaaacttcgcttataagatgaactcccaaaccaaaattacaaagaccttgaggaagtctgccaccataagagacaatcagcaaatagaacaaatggcaccttcaaaagtagcaataacggaaccacctgaaaaggacttttagctaagtatatgtagatttctcaaggataacctcaccaaccccatccatcatttcctacttccctccttaccttcctaacagaatggatttgtttctgaaaagtaactcaggaggaacagaacaaactggaaactgtggtgtttccatttgtttgttttgatagctccttcaaaatgtagatcctaatgacccagcggagaatagtaattataaaattaatgtttctcccatttaaggatgaattattctctaaaaactaaatataattttaagtaatgtcttgctcctgacaataggtattttatgaaagtattaattcaggttttctccctggtgtgaaatgcagaaactcaatgtttaaattttagggaactgatacattttctttattcattcttctttttataagtagcataaaactttaatttttaaatggcatatgctctagaattagtattcgccatcttttttattttattgttctgtggagtattcattttaaatatttacattttaagtactaaagcaatctgagcaaccctccctttcctgtctggcacagaagagtaatcacagtgagtgaggatgcagaatggtgaggtaggttggagagctctatggagacatggctgtgggtgggtatagaggtggtgggcagaggagacagctggcaatgttggcagattggttatactgaacaaaatgtaagttgattaagcaaattaggaaatgttttcaggataagatacagaaatacttatagatgtgtaggtattatacatgtatacacacatagatatttcccagctctgttgctgagaaggcctaggatcaatgaccctcagtaacaatgagcacattgggtctccacctcttagttctcaaagccatcctccactaaaaagaaccagagctccctgacaaaatgactgattctgggactattgcaggaaaaaaagtataatgtgaaccttactggaccagaaagtaaagaaacacttaatgaataatagtaaaatgtaaaacatacgaagagcccaacttaaaaggactcccagtggccaaaatggggacaatttgagcatcagtgtaaataatgatagtaatgtattaccacctgtcaaaagaagccatgaatttatcctaatgtaagtaagtatataaataaatgggggagaggggaacactcttccttagagtagaatgtcagctgatatatgtagaaggaaagatagcaatggagaatcaccgtttgacaaccatcataaaagccactaattcaggaaggagtctttaatggattctaaggctggtgggtacaagtttgatgaccatcaggtactggtgtaatctttgaatacctccccacaaagtactcattatttatttatttattttagtttattattctttttcagacagagtctcactctgttgcccaggctggagtgcattggtgcgacactgcaacctccacctcctgagttcaagcacttctcttgcctcagcctcccgagtagctgggactacaggtgtaccacactcaactagtttttgtattttttttagtaaaggcaggatttgaccatgttggccaggctggtctggaactcctggcctcaagtgatctgcctgcctcagcctcccaaagtgctaggattacaggcatgagccatggtagccagccaaaatactcataagttacaagggtgtaaatggtaagaataagatggagaagccaggcaaacaccaccatatatatatatgtgtatatatgtatatgtgtgtgtctgtgtgtgtgtgtaggtgtatttgtgtgtatatggtagggagaaggggtgtgtgtgtgtgtacacaaatatatatatatatatatatatatatatatatacacatgcatatatatatacatatatatatttacacacatatattgtatatgggggagaagaaaataagcaaatacagtaaaatattagctactgaggagtgtatatgaaggtgaaagagttctttgtacttttctggcaaactttctgtaagtttgaaattatttcaaaataaattactttttaaaatcaagaaaaaagtacaaaatgtggccttataagaaaattcagcaataaacacagatgaagggccagtgcttgcatggtgagtgctgagttagccttcaggcagttcctttttaaaattccatattcgacataagtctggataaataataagaaatacttaatatagcttcctgatttatagtacttcaagattcaaggccttattttcatcagtctcccacagggccactcacagattgtccataagttatctttaaccaactctcatgagtaggaacagaactaggcaccagggacttataaaagtgtaagatctagtccgtgactcccagaaagctgatcagttacagggggagaagcagggcacgtgtaaaaaagacaaatgattttgcacaacaatgcactagcttaatgtcgaagaaagaaaaacagttaattccgatgagcttcatgaaaggataggatcaccagcgaacagggtggccaggaagggcatgtggggaggtggctcggattcataggctcttcaagacagtaggctttttccagcctggctggccactagcagaacttggcatcccctctctgagggcgcccacctccacctgaatacctccagaaatggagattcatgttcttctgtggcagcctatttccctgttggaaaggtcaaattagtagaaagttcttccttctacagagccagaatatgcctgtttgtagttactctttgctttctactttggggcaatgcaaaataaccttagcttatcttctgcctataagcccttcacatatttgaggactgttgtcatgtctctcctaatttacctttctcgtgccaaacactttcagttattttagctgctatggaattattagatctttcactaacccaggtatactaatgtattaatgaatccaaaacacgttcctagtaagctgtagtctgactaatgcaaaatacaaccagattattacctccctaaattggaacatcatgtgttatttatgcaacctaagatttcattccctttctttggcagctgcacagactccatgagcactgaaatgcttaggtattatccatgtgagctgccaatcccccagcatgtacttagtagctgattttttaagtgtagttttttgcctttatccctattaaagtttgcctaggtgaaaaggttggtcccacttgaaatcactatgaattttgattctcatctaatgtttagggtatgccttttagatgtgtgttttatgcagaattgatacagtttatcttgcactgatttttattgaaaaaatggtgccaactatagaatgttgaaattcatccgtagagatgctacctcaggattattgtcatcattaatcaacactctttgctgtggcatttaaatatgattaaaaataattctctgaccagtccccttatgtcatctgaggtttgcttgctgtctgctctttgaccagctccaggcctttgaagaatcccacttttaaattgtccctataaaaactaatttaaggaaaaaagatacaactctactgaaaggcatcatcaaaaccattagagtcaagaaatttgttaacaaaagggatgtgtctccttccacaaatgaagatggctgaaacacacattaaatactatcctgataggcaccaagtgaatatcttggcactgtaaatgaaagataaattatacactaaaatggaaggattggtagggtatcaggaaagcaacattgaaatggaattcgtatcctgtggacccaaaagcacttatttttgcagataataagaactatcagccaggtatggcggctcacgcctgtaatcccagcactttgggaggccaaggcgggaggatctcttgaggccaggagtctgagactgacctgagcagtatagcaagaccctgtgtctataaaacaaagaaataaataaaacattagccaggcaccagtggctcatgcctgtaatcctagcactttgggaggctgaggcaggcagattgcctgaactcaggagctcgagaccagccggagcaacatggcaaaaaccctgcctctaccaagaattcaaaaaaaaaaaaaaaaaaaagaattagttgggcatggtggtgtgcacctttggtctcagctactcaggaggttgaagtgggaggatcgtttgaacctgagatagggaggttgcagtgagccaagattgtgcctctgcactccaacctcagggacagaatgagaccccatctcaaaaataaaataaaaataaaatactagctggacatggtgttgcatgcctctagtcctaccttgatgggaggattgcttgagcgcaagaatttgaagttatggtgagctttgatcatgctgctgcactccagcttgggcaacagaacaagaccctgtcaaaaaatacaaaatataaaacagcgtagtgttttaaaaaatagaatccttatccaatggaccccaaaacacttcattttagagacaataaaagctataaatcagaaagtctttccaccagcagtgaaagtgagaatgtaataaggcttggataagtgttgtatttatacatctaattgtggatctgattattaattgagtagttaatattattaaaaataatggttaataattaactcttcctcatggttataatccttagaacaaagcagttagtttgccttttgtcatttatacgttatagaaaacactgtagaaagtaaaagaattttttttttaactctaggagaattaagcacttggtaaatatatagatttttaagcatcagtcctctggagttcagaatttatcattctacacagtatgaaccaaccacaagtaggaaagtttagggatgttgttggtcctatttattgttgctatttaattacatccaaatccagccgtcagttcacatcttcagttctaattgcctttgagagttctatgcacggaacaatagctgaagtgactcttcagaacagaagtcataaatataggttcttcctgatctcgatgaattaaaaccaaaggagaggagacagtttgttttgcaggaagccatctgtttgtttgtatacagggtttgtattcaaattttaggaaattaatcaagtaaaaaacatcaaaattcacaacacagaaaacaagagtactgaacaaacatacactttgagaaaaccaagtcgctaatgagattttgaacctctttagtttaatcttttcttgtccctaggagacctctctggtatgtgtacagtgcatgacgttgcattgattcttgctgctttaaggctcagaacatgaatcggcgacaagtgctgagttaatgaatcagcagctgtcagcacaacaactgcaccaacataatccttgactcagggaacttctctggtccttgcttaaaagacagctaagtttaccaataataaaaatctgtcccagatccctacatgtgcataaagaggtgaacgtttctttaggaaagaaatgtcattcagaaacgtgagccagaatttcaaatggctctaggctttggggtatgtgccaactccttgctgctagcccaaaagttgtcaggagataggaagacaagacagttttagggactggagcctgggcatttgactccacactcataagtctgatgtgtaggcttagagctagagccaccattttaggcataaaatcatcactgcttgttacctgtctaaggcagtaactacctgacacgtgcagtgaagccctctgcaaccatctgcaccccatggcagaaattctctgaattcctcctgcgtttgaatatcttcagttgactacacataggagtgtaaattgctgtattatgcccttagacttattcctgcatgatttgcatgtggacatcgtgttttcagtgaaaagaaaggcagaatcgcacaacagacaatatcttaatgactcttagacatcagtctgctcatttgttaaatagggatgataatagtacctatttgttaggaataaatgaaataatccatgtaaagtgcttaacagtgctaagggactcagttattatgaatgttcttattccttcagcctctgttatatgtgttatccatgtaaacacaatccatgcttggcggataaatcaagaaataaatgaattaaaatgaaaatctaaattgcagaatcagtgggcagctgtttaaagtagaactaggcaacatctttatcaaataaaacccatagaggtatatcattttagcctgggatctgtttcagtcttcattttttcttgaggaaaatgtaaatttaaaaacgtcaaatgacatgttaagtcaaaatggggctattccttgatgtttgcttagagtaagatttgtacttacctcttttcctcattaaaaaaaaaaaaaaaaaaaaaaaacaacttcatcactatctattcctgatggtaagtgaatcaatatagcggatttttattatgtagtcctcaaaagcctcggtctttcaaatcaggggttttctatcccattacctctttgctggcagtacctgttgttcacttctcatttcatggacatcactcatttaacagtgactaaaagcacattaatctacttatcatgatcttttcctatttttagaaaacaacaaaagtatatcccactactagattataacctatttagaacagagatttcccttttgtaactgagagattttctttctgtagttggataaaaggatagaaaaaatgttttaaatactctctttaaagaggaaattttagcatgggttatcagcaagtaagactcacaaaaattctcctgtcagatataattacaaaattcccagcggatattttaatcccagaggttccctgaataaatatttatgtacctcacagcctgaaatgcaatcccgcgactatgggagaggattagtcagtgttcttttattatttggtttggttttggtttgtcttctttgtaattgtttgattggctcggtttggtttagtatgtagaaatttctggaatatggcctaattcagaattttattctttaggcatgtatgcggcctttacattgaattcaaactgcttctcactagtgtactctctgacaccatttatgaaatcatgttgcagaaaaataaggcactatgggtgtgaatgtagttttggagttcataaactgtctcagctaagcaagcccattctattcccagtttaaactataatgtaaagggtgaattttaaagcgaattgatggtccttatttttaaaaagtaatatacctgtatcattttgtcagtgatgttcattacagcattatttattatttctaattataaatattagaaaaatgtctaataaaatttgctaaaatgccaactagtttcaaaatggttaaaactgtaagcttaaagcagattataaaattatgttgacaaaggaataaacatgcctatacaatattgaggagaaaaaggaaaatcgtatttgtctcatttttataatggtgtaaaacaaaacaactgaaaaactgtgaaccaaaaagactgggggaaattataccaccatgaaaatagatgttttatctgggtaggatttgtttttctattccttcttttaattttcctgaatttcctaaattacctgtgctaaaacatttattacttttacaatagaaaaaaagagcctaacaaacttcaaatcaacatggatttttcctgtttgcactcagctgaaatgtagctttctagtgaaactggagagagacgaaaaccttttcaaagaggcaattcagagcaggctgccagaaagtaagcccttccacgagcatctttagagatctcacctccatgctccctggctgagttctgttgctctgagaaggttcacataatgagtgttttcatcttttcatattaaaaatgacctcctggcctgagtctgagcttcccagatgactgaggtttgctggtcacagcctcagaaaaaataaagcaaaattacttagtatttcatcctgctcttggagtctacattgtatttccacacaagctcacagactttgttgttgttattgtttgttttgttttaactctccagatccaacaagggtaatggtacccccttccagtatggatgtcactgttggagagagtattgttttaccgtgccaggtaacgcatgatcactcgctagacatcgtgtttacttggtcatttaatggacacctgatagactttgacagagatggggaccactttgaaagagttggaggggtaagtattaatagcaaaaactgactcaaactaacttgtttagaccaacttaacaatatatttaaagttactattttagaattttgttcaagtaatcttatggcaagaaactcttggttaattcctgctcctttttgcacaataaatgtggcatcactcattgaacaactctatatggcaggactgctccctaactggcaccaatcctacaggttaattattcattcctgtgtatggattagaaactaaggctcacaggcattggatgacttgccttggcctcatagctactgaattgtggaactcagcttaaaacttcaaatcccaaactctgtgtcacatatcatatcatatatcctagaatctgaccaagaaaatagcttaaggatagtttccttctgtttttaggctgctaattaaactccctttgaccttgtagaaggcacgtcattgtgaatttagggttttctttcttgaatttgaaagtctgatggggttatttactatctccaggtaatttgaattcaaaatgattggattttcaaaatgccttcctttccataacggtatattatcattgaacacataacaagaagaggttaaatctgggaacaattcctatcaatcacaatcattgtcaaaaaatttttttctgctctaacgcacctctgtgatcccattgacaataaagatggactccggctgccatttttatgatggagtccagccaaaacatagcggaatacaaaaatggggccctgacttgaaaagctctccccacttcctaggctgctataaaaatctgtccaccccctttacgttgagaataagtggcctaaagtcatccatgtgatatagtgagagcatattttccacccaactacagtactagccctgttcatcacagtcttactacctttatcaaacagggtttttgcagttgagtcacagaatgcccaaaacaatttcaatgactgttgtctcagttctatgccaagagtggtatctgattggtacaactttagatggcacaggaaagaagttaattcgttacatcagtggatgcctgggttcactagggattatctcttgggaccctgactgagaaaggctggatgaaattgccagcgtaaaccattctggacctctttcacatggttcagcttaataactttggctaagtgaaagaaatattaactacttcacaaagacattggagatattgaatatcctgaggtctaggaaagtacatagcccaatgtctaccacaaaagaagtacttgataaactttaatggtggtattaattgaaggaagggtaacattgattgtaataacaggaaagtgtaaatcgagaacattcttcataaattaagcagaatgttctcacattaaaaccaatttcttgggcaggagagatattaaaaatgctaaatctcagaatggcgcaagcaccaaccaatgaaaacagatgcccgaccaatcgaagtggacgtcctaccattcagacacatgtagcctttatgccagaatggtgccagggctaaggcagaaacagggacacctaatgaagtcaaacactgatgactaccttttgtaaagacagctgtccgtagagctgctcacattcatctttcatatggaaaatgtctatctcccctgttaaactagtgctaacaccaatcaacttctgctgagaaatacatagaaaattaaggacagcacaaccacatgtgagatctaagtgtactagccactaggatcattaatgtctgtggagtcaggacttgacaatagaagagataagcaagcgcaattttgaagtcaagcctatttcagcttcgacttcctgggtcagcatggtggaaatgatgcttggtatagagttaacctattgaggttttataaaagttattatttcattgtcctctgatacaccccatccccaccgagtattctgtcaggaacacaacagactgcggtggtggaaaataagcagatgctgttgttttctttggtaggaacataaaaaatgtagatcttagttaatagttgggtctgggtgacttcaaagggaaagagaaagttattgtggtctgctttgatgagactcttacctcactcctcactctatttttttctttgtttcagttttactttaaaaacacaaatccagtcaaaatgtgtaaataactacagtacttctgaatcgcaaaatcaaaattttctattaataggttgctgtgctctgaaatatccaggctgcaagtttctttgacatttaagcccttcatgaataaagtgaattagatagatggtataggcatttccctaaggccaatgtggcttcccaccttccctgcacgcatcccctggggcatattttttatttaaacctgtattcgaagtccccatatgtgaaatttcttaggtaaagtatcaataatcttaataatgatgatgataatagtgataattcctgatacttgcaaagtgcctaatcatttatcgggtactttcttatatacacttgacccttgaacaacacaggtttgagctgtatgggtctacttatatgtggattttttttctaccacactcagattgcaaatacaatattcgtgggatgtgaaataacccacatatatggaagactgacttgtcatatactcgggttccagagggctgactgcaggacttgagtatgtgtggattttagtgtactacggtcctgagtcctgagtccaatcccctgtgtctaccaaaggatgactgtaatagctccttaatcctcacagaaatcttgtcaaataggttaacaattattttcccattttattgagcaattataagacttgatccgtaaacagtggcatctggatgagaagccaagtgttacaaacaaaagacgttttgggttaaaataccatagcttttcctgaattagatttaacatcttggacatgtctgtttcacaaaaaaatggatcatggctgtcagtaataccagtttagagttaatctacgcttcaaggtttcagaagattttcacataacacagataatctcatttgattttcacaacctagcatgaaggtcaataaaggtcttttgaaagtcagtaaatcaaggccaagagagattaagagatttagatgaaatcacacagcaggaatcagcccaagacaactaagcaccaaaactgtagctcttccttcactccatgctttggcatctcttctaatcgtatttctaattggcaattctatctcttccattatcctgtgaatgtgacactctgtactgaaacgatggagataaccaaatacatattaattttgaaatagaatgaggatatggtctttccggatgctagtctagtgttactgttaagaacagggactatatgggttcaaatcctggctctgccattttctagctacgtgactttaggcaagactcctaacctctttgtgctggaatttcctcatctgtaaaataaggataacaagaatacctgcctcagaggacatgtgagtatttagtgagtttaatataggtaaagtacttggaagctgcctgtcatatagtaaataccattaaacatcatccattactattgtcattggagaaatagcaacacaagagtctgtgtcaatttcctgttgtatagtttggaatgggaaaatgaaggagggccaatataccctaaattatcttgtcatccattacgggtttagaatgaagtgtactttttcaaatctggcctctagggtggtctcttcatcaagcagctattctccaaactttggattaacagggctatgaaccaaactccaaggtgtagcagtgttcttcaggtaaagtgctgcctttgtgatagcctgtggaatcatctcctcacatttattaaaagtactgtgctggcgaatgctggagaaatatttctggggcgcatagacatccaaaccaggatgtaattagtcccattcttctgctaatcaaacatgcatttggcatttggaaaccaaatgagcactgttccacactaggtgatgcgagatttccttggagaatctggtcttcctaatcctttcattccaacctgggagcaataacaatgctggctctaagaaagggttgagcaataaaatgcagatacttccaaatgtgggcttgcttccgttttccaaatacagagttctaaagtatccgaacgccaaccaaggccataggctgagggcatttctgaagaaactcacaaaactagatcgagagccaccgtagtacgtaggacttatgtagcatgtaacttacgtccttccgacatgggtgccaaactgctccagagactcagagaagccagacacctgaggtcttgtcgaagatgtgttctgaaaacgtcggtgttcccatctctcaggcaggctcacatatttttaacaggccatggtttgcatcactaatgctttcatcagccagtgtaaaataaatccattagtcaccgtgtccttcatgtgataatgatatttagagctcattaaaaagtaattgcagccactttcccctactttatcagcaggattcagctggtgatttgatgatccgaaacatccaactgaagcatgctgggaaatatgtctgcatggtccaaacaagtgtggacaggctatctgctgctgcagacctgattgtaagaggtactggattttgttgttattgttgttcttgaaatattttcatgatatctactgtagcgcagagttccagaaacctcagtggtttagaattatgggaaaaagtcaggcagaagctgaacattgtaaacagtggctaacagtccacagaagtttctggttcatatacagttcctcagtgcggcttgtcagaaaatgcaccgaacacatccagtaactttacactagaaggataattgagtaaatcgagtacccgattacggctgttggagttgatatgaccttctagaacaaatttaggtgaacaaaagcagatagtttaaagagggattaaactgtccctttttatgtttcatctgggccaaactgaattagtatcctaggccactggtataacagcagcttaagtaaagtcatcatcaggtttatccgagtttccttttttccctaaacttcacagtgctgttcggttcctaaaatagggttttgggagaggacacttcctgactgcctgggatgtagtaaatgagctgagagttgatgtaaatactaacatttttgagattctcttgaatattatcagcatgacctaatttggacctaagagctatgacccccccggctgagcaacaccaactgagtacattccaagcctcaccaaaccggttggcaaaggaactgtaaatggacttttaagaaatatttttaaatgaaaattaaaatcttcactaaccagtgtacataccagaatccaacctatgcatgctcaggggttttctatagcattaaaatagaggccaatccagacatcaaaataatatcttagctagaatctccttcatcagaatccctgactgttggtgttcaggcatctttggccggctggcagagcgcatggcaaaacttcgaacgcaagaaaataaaaatttagggtatgagcgttggaggcagggttaatctgcatgcacagagaacaaggtattattggaagccataaagagtgttgctgtatcctctaggcataatgtaaggggggaaatgtgtgggagttaccaacttaaactgattgtgaagagagggttcaagagaaatagcaattccaatgtgtctgctttgttcccctttcaattgcctttaaaaaaactttcagcaacagtgcagacaagggctggaaatgagaaaaaactttcaaccgaggtagatctgcccacagaataacttatagaaatgtgtttatttccatttgaaaatacaccaggctggtctgccctccccttgggaacaaaagaattctgttgctgaaaatttatcctctatttaattaggataatgttcagatcagcagttaaaacaccaataaattagactaataaatatttaaatcagcaatacttgaagttcttaaatgatattgtatacttcatttcacagaaaataacattaaataccaggaggaatttgcaaacgcagtctaaaagaaaatctagtctaatcagttaataaggccaataaattaatgtgccatttaaaaccataatctttcattttatctccttctgctctgcccttgcagcttttcttgcacattacagagggggaggcaggaatgtatttcaccaccctgaaagacattttcatatttgaaacgtatagcagctttgagtcttggctccagattctttgattttctgaggcctgttctatttaacctatagcactgtaatggcagccagaaaggccacccttcctgagggagaagcagaccccagaatcaaactaatcttccctttgccattgcctgaaacaaaatcttctacatgcccctgagtgtgttatcattttgttcagaggacaaacatttgtacatttttcattttgaaagagggagtccacttccctaaaacaaagttggtaaacattctgtaaggtcgtagctatgcatcggtaggagagggtggcaggaagataaaaaaaagaacaaacaaatccaggaaactaccatcttctctccagtgtccaaactcataccagcccttcattttcttcctatagagaggccaacaatggactcagatatttcctatcgatttaattctttgaagagttcagagggaaacacttttctatttgtggtacttagattttaaaggacatcagtgcagcatccattaaaaaaaatggtggggaatgctaggatgagaaaactagtgaaaaaaattatattgtcttctagactttatctggttaaaaggggtcccaagaccaaaggttacatcagctctatctaggtgacattagactgacatgctgaaatgtcaccatggaaaattaatcagttccagcatacagatttccagacatttcattcaggagtgggagggagaagataaatttagtctcacctgtgggtctataaaagtgatttttaaaaaaggaaagggaatttagggcatcacgtaaacggtgaaggagtgaatcctagaacaaaggctaacttcaggaaattgctgttaattttgcactgctctgtgagaggtttcttttttccctgtccctgtgacatggcctgatagtatttgggtagtacatttgattgctagactggggattagcaaatccttcctaggaacatctccttatgcccgtctaatgggcatgaggtttgtcattatgtcccctcaccatcaccttccctcctgaggtggtcaattgtaccttgttaaaaatgcatttaactgcctggtaagagattttcatgttggaaagtgggatagctgcgggtctttgctctggctctgttgatattttgtctttacctgccagctgctttccatccctctatttctttattagtttcaagccttcatttaaatctgatttcctcccctttccatggtttaagtacatggacagaaacaacgaacatcaggaagagaagtagaaaaatacgggtatgagttgcagaaactacagatgagggtctttagtatctagcctaattttgaaattgctttgaagaagggagcgccttgactcttgcgcaccggccattttcacagcagttcccttgcacgcaagtgtgtgctcacgtgggaagcagggttggatgtgaagagagtgctagtaattacagtgcagcagaatgtgcagagcaacactgtaaccttcaaagttttaaagccatttgtgcttaaatctatattctcagtggtagaaataaccatttccagcagactatactctttatgaaatcaggagcaatatctatcttttctcactaccgtatcctcaaataacactgtctgacccatattaggaacctataaataaataatgaattaatgaatgtgggctcttatggtaccccaatactctctattaacattaagtattcagttgtaattatttgtttacctattagtttttcatattaaactgtgggcccctagaaggaaggggctgtgtttcattcacctctgtggtttccaagcccaggaaagttccaagcacgtagtaggagttcaaaaaggatttgacaagtgatgaatctgtgaatgggtagataaatgaatgggtcaatgccccattcaagtatgtggctcctttacttgggtgtttgaatacactgctccaattctgggggtcttgctctttcccaggtcctccaggtcccccagaggctgtgacaatagacgaaatcacagataccactgctcagctctcctggagacccgggcctgacaaccacagccccatcaccatgtatgtcattcaagccaggactccattctccgtgggctggcaagcagtcagtacaggtaccatattggatgcttggctcagagacattgggaactcagcatactggacacagcactgtggcaaggaacgtctaagttctcattcagacactactacaaatgatatattatggcagtgtttcctaaacctcggccaactgtactatcattaatatttttctttatatcaaatcacagttgggtttttttaaactcatcctaagcaatagtatctgtgaaatggtaatgtccaggccagatttggtggctcacgcctgcaatcccagcactgtgggaggtagagttggatggatcgcgtgagcccaggagttccagaccagcctgggcaacatggcaaaaccccctctctacaaaatatacaaaaattagcctggcatggtggtgcgtgcctgcagtcctagcaactcaggaggctgaggtgggaggattgcttgagcccaggaggtagaggttgcagtgagccaagatcacaccactgaactccagcctgggtgacagtgagactccgtctcaaaaaaaaaaaaaaaaaaagtctgttgtgctggttgtatatgtattttccgtaacacacattaaaaatatattagttataaaaataaaatgcatcaatctgtattacctaaaatcatctgtgtagcactgtggttcactttggaaagcagcggattctgcctgactatagtcacttaatagtcacagacttcataaagtttacacagtgctctcaaaaaccaataacagaggattatagggagcctcttcacttgctgctgtgttttttgagacagggtctcactctgtcacccaggctggagtgcagtggtacaatcacagcacactgcagcctcgacctcctgggctcaagcaatcttcccacctcagcctgttgagtagctgagaccacaggcgcaggcccccacacccagctaattctctaaaattttttgtagagacaggtcttgctatgttgcttaggctggtctcaaactcctgcgctcaagcaattctccatcagcctcccaaattgctgggatttcaggcgtgagccactgtgtccagccccatttttttagatggataaatttggggataaaaagacatgagatttctttttaaccaattttacaaattcttaaaaaaaaaaaaaacattgttagcagcaacacttccatcctgtttccctttattacatgtatacagcacttcctattttttaaaagtttcacagttatttctctttgcatgtaaaagaattcttataccaaccccactctgtcagtacctccaaattgactcattttcttatttagatttcatttaaggataaattggatgaacaagtagttattacaaacaaagatacacactcctctagacagcaaaagtaggctatatggccttgatgttttgaaggagaatatgcccagtgttgagcaattcatataaatcttgttgattttaacccatttgtttttttcactttagtttactaatccttagaaatgggtttctgtgtttccttctgtaatcactgagtcacaggtgtgctttaagaaggaaatatgagaaaaatatagaagttaggagatgaattctagacctgactgctaatcagctgatctctatacatcttcattttcctcttctgttaaatgggcacaataagaattgtttaagaatgaatataggccaggcgcagtggctcacaactgtcatcccagcactttgataggccaaggcgggtggatcgcttgagcccaggagtttgagagcagtctgggaaatgaggcgaaatcccgtctctactaaaaatacaaaaaaaaaatagacaggcatagtggcatgcacctgtagtccctgctactcaggaggctgaggcacaagaattgcatgagtctgggaggtggaggttgcagtgagccgagattgtgccactgcactctaccctgggcatcagagagagagagagagagaccctgtctcaaaaaaagaaaaaaaaaaagaaaagaaaaaaagaatataatacttttacctttctcagaggatagttgaaatagtgtgtctggcactatacaataaatgcggaaacacatgtgaaggggtgatagtaatgattgagtcaggtagtttggggtcttgtggactgtgtgtcttttatgatgtcatctgctggtatctgattagagtgtgttagtttaacatacagagatagttctgagattacctcactgaaacaactgttgatgcagctaatatcagaacacctacactgccctgaatacaataatgatgaggatggatggatgttcctatcttcctaacgtaatctctgcatttgttttctgagaacctatgaaacagcccccaccttttgttgtctttcagtcccagaactcattgatgggaagacattcacagcgaccgtggtgggtttgaacccttgggttgaatatgaattccgcacagttgcagccaacgtgattgggattggggagcccagccgcccctcagagaaacggagaacagaagaagctcgtgagtagcacccgagattcagatcatctgttctgccagctgctgttccttaggaaaagcgtttgaattcttgctgctcttcagcgctcatgcggctctgtgttagctcacccttccctttaaatgtttataatgatagaaatcaggccaggagaagcccagctgaacacgcaacgggtttcaatcaagagttgttttcttcattaggtccacttgtacagcaagagacacacggtgcttagtcctctcaaaagccagccctttcttcattggttcatttgtcaccaagattctaacagaatttcaaaaaaaaatcccacatttcaaataaaattatctcacataagtaactaatggcaaagaataatttgtgactgctctggacacagccaccatggggtaatcctgtttagaatagaaataaaaaataatttcttcagaaatgttcacttagattatctttcttagggtataaaccattcccagaaacgaagattcagaacatcgtgctcattcgaacaagaccagtcagcaattcagtatggccctctgcatatgcagcttgaatgagcacggggagagaagaacaagttcatcagggtcagccgtacttttacttagctggtgtaaagcaagaggcctacatgtgccgtcttttatagagttcccgcctgtagagaggccagtgtgttgaaggaataataaggtccctacacaaataggagttctgaccctactctcagaaaagcaaaaactcatctagatctatttgattggctttaaccaaggagacatacccagtcaccagccacataccccagtgagacctttttaaatgtggcccggagcctttcagttacgtgatgacaatatagctagtcccctgctttcttttccccttccaaaaccataattgaattaattcccctcagcaatcctgaggtggaagctcgcataatttcctctcttttatagagaaaactggtgatcaaagaggttaagctcagtgagccgggggtcaacttctgtctgccacttccttcaacactcagatcaaaactcttcctcccagaagccattcgcccaccccagctctgagcagggcgctactccggaacgccccccgcttctccatgctgactgttccttaccctggttgtcgaccttgctctaactggtgcaggcgctcctccactccaaccagcttgtaagctctgcctgggcagagcttgtactcttccctttgtgtatctccacgtggctcataaacgcataaccaaacattaggaccagacttcagtcctttcctcccttcgggaacccctcggcctctagggatggagctgaacaattggtcagacgtgtcagataacacgtgtgccttgttgaatgggaaacaggtaattaatagcagtctccttggtacatttcacttcctcgagcggtcgccgtgggccccttgacaatgctgttgctgatctccagagacaaaggggcgtgcctcagagtactcactgaaagtgagtcacctctgccaggcaaccttcctggccctcattcgcctttgccgcctgacataacttgttttttgtctccttgtgcagtccccgaagtcacaccagcgaatgtcagtggtggcggaggcagcaaatctgaactggttataacctgggaggtaaatgaatcacagaataaaaggaacgtacacgcatcgaagctattttattattttcctccatgttagacatagctgggaagtttcctcctctgtttttaacagtgaaaattcatttgggttcagacactccctctcacgtagctaatggctagcaggaaggacggcacttgcccatccattgttgaggcaagttttaattcaatccatcacagtaaaaacaattatgaagggaagacaacacacgttacaaaaaaaaataaagaaggctgtttcagagaaaactagtttttcttttcttcctgaattgctgcatggccaattgatttaaaacgtctgccagcaatagattcagtgcaccagcacaatttcctggcaattggctttgcttctagaaggggccctcttttaggaggtattttttaaaacaacctggaggaaagttagtcaccaatttattaaaaattggctttgagagaagaggtgggagctttagaaagggttcttcatgtttttgaaagattctaaacagccccagaaattaaaatctctcatttacccaaagcacagcagtgaaagaaatcactcatccctccagctgaactcttccctctgagagggaggatcttcagccaagatggtttttcttccttcagtgagatcttttgtctatttggcaatggaagaagattagtattagaggatacgtgttggaaatgtggtttttcaggagaccgatgtccagtgtttttttttttacaatcatttccaaccatttcagagctgggtctgccccatcaaagagcaagctctggactgcagatcctcattacgttttcaaccctgtccagtacatcataactgtttaagatagactgactgcaagccctaaatttaaaagactgttaacaaaacgccaaataagatgggtggagaaggatgtagacaagaatgttacaagggaaacaaaaacgatttttgcatttgagtgaaactactgtgatttctgaagaccaccttccttctttcccagacggtccctgaggaattacagaatggtcgaggctttggttatgtggtggccttccggccctacggtaaaatgatctggatgctgacagtgctggcctcagctgatgcctctagatacgtgttcaggaatgagagcgtgcaccccttctctccctttgaggttaaagtaggtgtcttcaacaacaaaggagaaggccctttcagtcccaccacggtggtgtattctgcagaagaaggtatcgtttatgctgcctagatcattgactgttaatatttcttcaattctaaaatgtggattgtagcacgtacaatcaatttcgcatggtacatgtatcttgaaggcatacctgatttgagaagaggataatgtaaacaatttggttcgctgtccaccatgaatctcttgaaaagatagcgactgctctgtatatgaaaacacttggctgtccattattgattccattgctaaggaccagaattgcaaataccatataagatcttcatatctatctatatgttatcattactttcaaaagaattttatttttgcctttaagtgaatatcaaaatataatttgcattttcttaccacttgtattttcataaagcatatggtacttgtggctcacacctgtaatcccaacacttttgggaggccaaggcgggtggatcacctgaggttgggagttcgggaccagcctgaccaatatggagaaaacccatctctactaaaaatataaaattagccagttgtagtggcacatccctgtaatcccagctactcaggaggctgagacaggagaatcacttgaacccaggaggcggaggttgcggtgagccgagatcgcaccactgcactccagcctgggcaacaagagcaaaactccatctcaaaaaaaaaaaaaaatctcacttattaaagaaaagagtaagtcatgaagcagtgtgattgcgctcactgtcatccacaccatcattatgtttaacatttctcacacattattatcacctccatgctatccctgctctcgggatgcctctcacacagtcttcgttacctttggagttcgtctatgttgttttaaagatgatgctcagaatgggaccatgttaaaacatctgaaaggtgaatcattgatttagagtcagtgaagatgcaataacttattcccaatcagagagatcatccccttagactcagtagccctccatgatctagctgctgcctctctgtctgcctcagctgctgatgcctttccctgcatatttcatgttccaaccattgccaaaggatttacaattattcaaacaagcttcagcccttttcatagccttcaacttctcttagataatagttcatgtctctggattatgaaaatgagaggaaaaggggaaaaggacagtcagctgacttgactaagattcaagagagctggatgacacttcaggttcacactgcaatctgtatgatcttggataactcaggtatactctgtgggcctcagcatctttggctgcaaaggagaggctagactgactgtttcccaaatttcagttatttttgccagatttctgccatagctgtgtaccatttgtatatgttcacatttttctttcaatagtcttccttaaaaaaaatttagtgggcaagcacagtggctcatgcctgtaatcccagcactttgggagggggatgtgggaggatagcatgagcctaggagtttgagaccaacctgggcaacatagcaagatccaagtctttacaaaaaaacattagccaggcgtgttggcacatgtgtgtgtggtcccagctacttgggaggctgaggcgggaggatggcttgagctcaggaggtcaggctgcagtgagccatgattgtgccactacattccagcctaggtgacagagtgagaccctatttcaaaaaagaaaaagagaagcagtttagccatgtcgtaagcaataacatttgtgagatgctaattaagaaggatctgtgttaagggaattgctggctatgaaaacttggtgcttaaacttaagtggttcttctcttctacccacacctaaattcagaacccaaacactggacaaatattcactaccaccaactccagctattaatcactgcccctctgcaaaatgagggtttggcttacaatcattaaggacgattctataaccatgaattattttaccttataatgctagtatctacaatcctgtcctaatatagctgatagagtaataactatctccatattcatctacagaacccaccaaaccaccagccagtatctttgccagaagtctttctgccacagatattgaagttttctgggcctccccactggagaagaatagaggacgaatacaaggttatgaggtaggcaagacatatgtgccttgggtctgaaagagagtctatgccccttgataagtcctccaagtcacattcttataggaagagacccacattcccactaagaggcattggttttaggcctggcttccagctgaacattaatggaagcattgaatactcagctgtgagactaccctttttctatgttatattctagaggtatttttcgaattatatgcaaatctaagcatttacgggatggttggcaaaatgagctttgacttctgatatgcccaggatcactttgactcaaaacaaacatgggaaaaaagaaaataatgaacgacggttgtgtcaatgtaccgtctcactaggaagctaaggacaaaaaagggacccttcttactttggataatttctcaggatatacagagtcctttgtcctgatagctctgctcatgatgtagtatagaaaactaactccatcataagaatctgcgtacaaaattacctgatgacattgcaaatatccccattgggtatggtttccaaggtctttctgtttatcttcttaggttaaatattggagacatgaagacaaagaagaaaatgctagaaaaatacgaacagttggaaatcagacatcaacaaaaatcacgaacttaaaaggcagtgtgctgtatcacttagctgtcaaggcatataattctgctgggacaggcccctctagtgcaacagtcaatgtgacaacccgaaagccacgtaagaacagacttgctcagaaatattttggggattcatcacacatatcccaagtttattccttatccccacctcccaatgatcatttgcatactaattagtagcatgtggattcaaatttccctcagcattttaactgaacctttccgtataccacgcaaaattcattgctgtggaggacagaaagataaatgtttttctcctcactgggaagggctacttcttttagctataaatgttaggcgaccaactgaatctttttccatttgcaatgctgtatctcatcagattttagtgaccttgaagacacatattagtgcaatagcccattaaattgcctccactctcgaattctagtaaggagatattcctcagaatccattgagacttaataatctgtgacttcgtatatcttaatttttttatagcaccaagtcaaccccccggaaacatcatatggaattcatcagactccaaaattatcctgaattgggatcaagtgaaggccctggataatgagtcggaagtaaaaggatacaaagtaggtaatttcttttttgcaaaggcacctaatcgtgctgtgagtgggggcagtctcctccatgaattatacagttgtctgcattgtcagtttccctggtgatgctctcctaccctctaggaatcgctgcctccaacacggtttgatctgagttgtataaatagtctatggcaattggtcaggatttagacaatcaccttaactttagtctcaggcagcatcaatcagaaatggataaagaccctgtgtttgggtctccaaaaataccctgaagaaccactttttaaacattcctactgtcagcttcgttttgctcctgtctcggtttatatatattttttagtcaacttagtagcctcctgatattaccaatgattaatcatttttgttcgtatgtttctatagtcaagagttatataaagaaaaagagaaaagagagaaaaagcaggaaaagtggagaaaatgtttgcctgaccccataaatgttggcttgtctttaatgagaaaatgaaaagaacatgtctgtagccttcttgcagcaatcaaaaagggttataaatatcttgcaacgtttccagctacctatttgctacctaacaaaccaacctgaagctaggggctaaaacagcaacagtgtatcattttttatgactttgcaatgtggatagggccagaatggacagattttagggctggaataactaagatgcttcttcacacacttttggcttcttggatgggataggtgggaaagctgaggctggccagtgatcatgctctctatgaggcctttccccacggataacctgggcttcctcacagtatggtgacctcagagtagtcggatttcttacatagttgtcagcttcaagaggaagaaagcagaagctgccagcccttttaaaagctaaggatggacgtgggcagttccaagatggccaaataggaacagctccagtctatagctcccagcgtgagcaacgcagtagactggtgatttctacatttccaactgaggtactgggttcatctcaatggggcttgtcggacagtgggcgcaggacagtgggggaagtgcaccgagcataagctgaagcagggcgaggcatcgcctcacctgggaagggcaaagggtcaaggaattccctttcctagccaagcaaagctgtgacagacagcacctggaagatcagggcactcccaccctaatactaatactgcgcttttccaatggtcttagcaaacggcacaccaggagattatatcccatgcatggctcagagggtcccatgcccggctcagagggtcccatgcccacagagccttgctcgttgctagcacagcagtctgagatcgaactgcaaggcagcagtgaggctgggggagggggcgcctgccattgctgaggcttgagtaggtaaatagcggcctggaagctcaaactgggtggagcccactgcagctcaaggaggcctgcctgcctccttgccctctgggggcagggcatagccaaacaaaaggcagcagaaacctctgcagacttaaatgtccctgtctgacagctttgaagagaatagtgtttcccccagcacggagtttgagatctgagaatggacagactccctcctcaagtggttccctgacccccgagtagcctaactgggaggtaccccccagtaggggcagactgacacctcacacagccaggtacccctctgagacaaaacttccagaggaacgatcaggcagcaacatttgctgttcagcaatatttgctgttttgcagcctccgctgctgaaacccaggcaaacagggtctggagtggacctccagcaaactccagcagacctgcagctgagggtcctgactgttagaaggaacactaacaaacagaaaggacatccacaccaaaaccccatctgtacgtcaccatcatcaaagaccaaaggtagataaaaccacagatatggggaaaaaatagagcagaaaaactgaaaattctaaaaatcagagcacctctcctcctccaaaggaacgcacctcctcaccagcaatggaaaaagctggatggagaatgactttgatgagttgagagaagaaggcttcagatgaccaaacttctccgagctaaaggaggaagttcgaacccatcccaaagaagttgaaaaccttgaaaaaaggttagacaaatggctaactagactaaccaatgtagagaagtccttaaatgacctgatggagctgaaaaccatggcacgagaactacatgacgaaggcacaagcttcagtagccaattcgatcagctggaagaaagggtacctgtgatggaagatcaaatgaatgaaatgaagcaagaagagaagtttagagaaaaaagaatgaaaagaaacgaacaaagcctccaagaaataagggactatgtgaaaagaccaaatctacgtctgattggtgtacctgaaagtgacggggagaatggaaccaagttggaaaacactctgcaggatattatccaggagaacttccccagcctagcaaggcaggccaacattcaaattcaggaaatacagagaatgccacaaagatagtcctcgagaagagcaactccaagacacataattgtcagattcaccaaagtcgaaatgaaggaaaaaatgttaagggcagccagagagaaaggtcaggttacccacaaagggaagcccatcagactaatagcggatctcttggcagaaactctacaagccagaagagagtgggggccaatattcaacattcttaaagaaaagaattttcaatccagaacttcatatccagccaaactaagcttcatcagtgaaggagaaataaaatcctttacagacaagcaaatgctgagagattttgtcaccaccaggcctgccctaaaagtgctcctgaaggaagcactaaacatggaaaggaacagccagtaccagcctctgcaaaaacatgccaaattgtaaagaccattgatgctaggaagaaactgcatcaactaccgagcaaaataaccagctaacatcataatgacaggatcaaattcacacataacaatattaaccttaaatgtaaatgggctaaatgctccaattaaaagacacagatggcaaattggatagagtcaagacccatcagtgtgctgtattcaggaaacctgtctcacgtgcagggacacacataggctcaaaataaagggatggaggaagatctaccaaggaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaaaatatatgcacccaatacaggagcacccagattcataaagcaagtcctgagtgacctgcaaagagacttagactcccacacaataatgacgggagactttaacaccccactgtcaacatcagacagatcaacgagacagaaagttaacaaggatatccaggaattgaactcagctctgcaccaagcagacctaatagacatctacagaactctccaccccaaatcaacagaatatacattcttctcagcaccacatcgcacttattccataattgacctcataggtggaagtaaagcactcctcagcaaatgtaaaagaatagaaattacaacaaactgtctctcagaccacagtgcgatcaaactagaactcaggattaagaaactcactcaaaaccgctcaactacatggcaactgaacaacccgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaaccattcaaaaaatcagtgaatccaggagctggttttttgaaaagatcaacaaaattgatagactgctagcaagactaataaagaagaaaagagagaagaatcaaatagatgcaataaaaaatgatcaaggggatatcaccacccttgagagtgggtaacagggttagaccagatggtaggaaaggacactttctgagttcttcttaatttccagctcagtcactcccccttctttttaggagtggtactggaagagccagacaccctacacctcctcaactacaccccaaggaaggtcactgtaactggctatacattttgaattgctacatatacatgtgaatgtttagagatacataatttaaagctacaggtatccacaggttccatactctcaaatgtggatcaaaaatattcaggaaaaaaaacacacaaaaaaatacaatgaaaatgacacagattttaaaaacaatacagtataacaactatttacataccatttacattatattaggtattatgagtaatctaaagttgatttaaagtatacggaaagatatgcttaggttatacacaaattctataccattgtatatccaggacttgagtatccacagattttggtattttagggaggtcctgaagccagttccctgaattaccaaggtaccaatgaataactctctctctttctctctctctctctgtgtgtgtgtgtgtgtgtgtgtgtgtgtatttgtgtgtgtgtatgtgtggtacctcccgtgatatctcacgtcccatgatagctcaggaaactctccctagtgtcacttttagggtgagattagaggctgaataaaaagcggatctgattgcaacggaagagttgacctttgctagagaatttgacccattaaatatggctattgtttatctcagactgaccctttccaaaattaagttttcctcccaaatactgaacatgttggggtgtgggtttattttcccttcttcactaagttgtctgaattctttagatctcagcttaggtagacagtctcaacaagaagctgactttagaaagtttaaggccccaaatattttgtcaacacaaatccttaagctactttatggcattagagctaaaaggagagcatctggttttagtatcacaaattaaactacctgcagggccaggcagataacataaatgagttctgttcagtccattcagaaactactactaatacgtctactaagcactgttccaattcatcttaactttatattttattttgttgtattttgagacagagtctccctctgtcacgcaaggtggagtgtagtggtacaatcttggctcactgcaacctccgcctccagggttcaagcagttctcctgcctcagcctcccaagtagctgagactacaggcgcccaccaccacgactggctgatttttgtatttttagtagagatggagtttcaccatgttggccaggctggtcttaaactcctgacctcaggtgatccgcctgcctcagcctcccaaagtgctgggattacaggcatgagccaccatgcctggcctcatcttaactgtataataaccatgaagataggtacagttattattgctagttttacggatgaagagctgtggcatagagtttagtcacttgcctttcacacagctggtatgttgaagacctgggatccgaatacagcagtatggatcctgagttctacatttagccacttggtgcttctgcctaccagccataaataaatagaataagtgataacaaagtactgcagagaaaaagaggctagagtgaggggaatagagaaagccatggagtggacaggagagatgtattattttatagaaaggccaaggaaagccacttttaagtggtgagatttcagttgggccttggcacctctctgggaatgtcccaagtactgcaaaaaaggaagtgcaaaggtccagaggtaggcatgtgacaatgtagcaacattggaagtgttgggactatcaccaactgcagagtttgtgattgttcagaatgagacttctcaactccaaccagttgttggcagacaggaatatagatcactggcttagtctattttattctggatcgcacttttgtagagtcttactcaggaacagaatacctgagactgggcaattaatatgaacagaagtttattgacacccagtgctgggagggagagggatagagagctgactcgcccttttacaacagtgctaattccatctgtgagggtgagcctaatcacctcatggcctaattatctcttcaaggttcacctgttaatacagttaaaatggcgaatttcaacatgagttttggagaggacaagcatccaaagcatagcaaccagtgtggccatatcttccagtttttcagtagaacccacaaatttttaatgtctaatttctcggtttttaaatgttcatgtctaactcaaaaaaaataacactatgacagccaaacaaataatatatgcaggctggttatgacccatgggccactagttttttgctgtctaactcccttggtttgtgttcccaaagacagatgccagagagggaaagcaatttgcccagagccctacaggtggtagccaaggtagtcttcgttaaaaatccaggttctgaggccgggcacggtggctcacacctgtaatcccagcactttgggaggccgaggtgggtggatcacctgaggtcaggagtttgagaccagcctgaccaacatggtgaaaccccgtctctgctaaaaatataaaatcagcagggcatggtggcgcatgcctgtaatgttagctacttgggaggctgaggcagaagaattgcttgaacccgggaggcggaggttgtagtgagctgaggtcacaccatcgcactctagcctgggcaataagagtgaaactccgtctcaaaaaaaaaaaaaaaaaaaatccaggctctggagccagactgcctaggtttgaatgcaggatccgccacttaccagtcatgagaccgggcaattgcttcacatctccacatctcaagttctcatctttgaaatcagaataataacattgccttccttaagaggttatccacataagcatttagaacaagcttgtacagcccacagcccacaggctacatgtggcccaagatggctttgaatgtggcccaacacaaattcataaactttcttaaaacatcgtaagatgttttttgcaattttttaaaagttcatcagctatcattagtgttagtgtattttatgtgtggcccaagacaatttttcttcttccagtgtggtccagggaagccaaaagattggacacccctgatttagaacacacagtgttcagacattaaatagtggaagtagtctataatatttgctattatcattattcccacaaatccattctttccccttgtcttccaccctagattatatcaaatgcaagcacagccttcaatcagctcaagcaagtgtttggtgtaaataaaggctttacaggactttatttgggttctgctgcagtccataatactgcaagactgataagcagtgctgataaaagtgctgctttttcctggaagtgtttcttttggatttatatttgaaacaagttgaatcctctgagctcttgcaaggaccagaggtaaatcaaagcagcaatttattcctcaaagccagatgtgaccttgcatcccatcagcccattctcctggagggccgtgatgagaagctttgacactcctgaatgtgcctgaggatttatctgtgcctaatcatcagcaaggggatgctgggtctgatacaactgatgctgcggagaagaaggggacacttatgaatctttctaccttaaggaaattgtgttttccaccttgtgttagagagatataaattaaggtgatgaaatgccagggaacagatgggttctaaaccattctaaaggaattttatgaatttcacttgtgtctggttttgtcttgagacacaagagtgaccttatgtctgtagcctcagcagatcagaatttataagggatcttagggaaggatgagctaatctcgtgcttctcaacgcatgatccctggaccatcagcactggcattagctgggaacttgtcagaaatgcagattttcaggtcccatcccagaactaatcacaaactccaggaatggggcccagcaatttgtgttctaacaagttctccaggtgattctgttcacgcttgaatttgagaactacgcgtctaattcatctaatcatgatgcctatcccatattaacatctcctgatgatcttttagaaaacaactacagcatggatcccacctctgtgcagtcttaggcaggctagagtggaactggagcggggttactgacctcctcacagtcaacactttgagctagagagttctttgttgcggggctgctctgtgcattgtagactgttcagcagcatccctggtctctctatccactacaacaggaggacatgttttgacaaacatgtctgcagacattgccagatacctccctgtgaggcaaaattgctcccctgcccctcccaccctgttgaaaaccactgagctacagcataagtattttacaagcaccccaatggttctaacatgcagccaggaccaaaaaccactgacctcatccaaccctatctttttgtcaggggaaactacagaggatgagctttagtggttctataggtaaaggcacactttcccagacctgtatattttgttcctgattggagtaaatccaatcacagcaggcaatcccaggtaagtgaatgtgtttttaggaggctagttggccacctcatcaaatgaatccacctccaaactcagaacccatggggggcccaagatgaaaacaggactgttgcaagctgcagatatgtccagggtgacaatggttgcctcttggctacctagccccataaagtggggttccagaggaaaggaatgggaggttactactcttgcctttccgatatcttctccctgtgctgaaatgtcctgtctctaagagtcgtgatcataacttattgtgcctggcttgtgctctaacctttgccatgtatgttctctgattatctttaagccttcagagatactatttcttacatgcttcctctaagctaggccatcaccagattcaaaccttgtgcaatcttttgtatttttatatttttgagacagtcttgctctgtcacccaggctggagtgcagtggcttgatctcggctcactgcaacgtctgcctcccgggtgcaagcaattctcctgcctcagcctctggagtagctgggattacaggtgtgtgccatcatgtctggctaatttttgtattttttgtagagacagggtttcgccatgttggtcaggctggtctcaaactcctggcctcaagtgagtcacccaccttggcctcccaaagtgctgacactataggcatgggccactgcacccagcctccttgtgcaatcttgaaaacacactccagaagactgggtattattgtcccccttttacagatgactgaagtgaggctctgaaaggtgaagtggcctgtgatcccacagtggccaagtttattctgatgccaaagcaccgatgtgtaactgagcactgtacatccttaaggagctactcatattttccactttcccaagagtgtcaactgagcctccgagaggctaggcagtaggtagaatcacgttgctgatgcccctgatataatatcctttcagctctttccttggaataaaatggtagctgcagtcatggccctcactgcaaatgagccttccaaatgcaagtgggcagccagacaacctctacatccctgcattttgctcgtgcccagaggtgaaaacaaatgaatgctccatatttgggacctttgtgaagacggcaggtgacacctgttctttctgtattggcaggtcttgtacagatggaacagacaaagcagcacatctgtcattgaaacaaataaaacatcggtggagctttctttgcctttcgatgaagattatataatagaaattaagccattcagcgacggaggagatggcagcagcagtgaacaaattcgaattccaaagatatcaagtgagaatgcctttttttctcccttttctcctgcctgtcttatcttatcagccttccagatgagtcagggcttgaaagacattcagcctgcaaaagcagacttaaaatagaaatggagaacactaccccccttctccagatgtttgctggccataggcagtttcatgcaaaaatcagtttgcccgtgttgactgatctactcagttgctaatcaaaaatcagattaaagcagacccgaattagtcactaaggtttttccgtgtcaacctgtgtagtttgcattgcatctattgtagccccagaattacagtttagaaagtgaaaagcattgactcagtcagaaggaacaaggacaagcattgttaagtatgccgtagcagtttttctccagtgaaacagtgtatgcagttcagtatcttggaaatatttggaatttactacttattttcaatgggtatatgcaacatgtgcatcaatgtgtatgtctctctatagtcaagattatcttcactttcaaatgttgttgaatagcatgggagaatagcatattctttttgagcaaatacattcaattctgtttttacaaataccatgtttgtaagtatcttaagagcatgatttttttgttgttgtgtgtgatctcatttatttaaagaaaaaaaacaaaatagccaaatccgtggagacagaagtgaggctagtgattggcagtggctggtcagtggggaatgggggtttaggcactgggtcttcatttggggtgacacaaaagttatggagcttgagagtggtgctggttgcacaacactggagtatacttagtaccactgatttgtacattttaaatgagttaaaatgctaattttgttatgtgtattttacagcaataaaaaaaagactgtggttagatatctaagtgtagactttcacaggctttcagatttcagtctggagattaggggagcagtgaaggctggaggtataaattttcaagacattggtaaaaagatgatattttaaattatggacaaaatcctcaccaccatcctgacttttagccatgtgacatccctctgctaaggggtgatatgccagtgtttctggatggagtttatatttactgcatcttttttgcatacaaacacaaaaggcatttttgtcttaaaagggggacaattggattatactttatcaaacaaagcctctaacttctatcgaaagggagctagatttttggtgagatgtggaagtaaaatctccaggccacaaaaatacaagattggggcttatctcgcttcattaaaaatctgactttatacttcatactttcttatcattgcagggattgacatttttagatagactgatgattcctggttttattcattacaaaaacatatattaagcaattatattggtgtaattattagataacaaggaagtgactgtgaaccaaacatgatctgtttcaagagatttttcatcatgttggtcaaagagaccttacaagattgaagaacccccgaatgacagttgatagcttcttactatgaaaagtgtaagacccataagaaaatttaaaaaaggattgaggctattttgtttgcagaaaaggggtagatttagacagacatgggtttgaaccccagtttagccatttactagctgggtgatcttagataagttactttatttctctgggcgcaaattaccgccatctgttaagcgaggtaataataatacctggccttcatccagtttttgcaagatttaagtgtcatattcatctgtgcccagcagaaagatagagttcaaaagggagcagcaattttcattttgttgaatcatcgacatagcatgctgtttatcagtattgttactagtaatattgaagtttcttctcacattagataggaacctccttactttacaaatgctttgacagaggtacagggctgtcctataccctactcccaggtttgtagcttggtagtcatagaactgatatttaaaagccattaagaccttgatcatcatttccagtagaatccatgcagttctgctgtttcaaaaagccccgtggcccctcttccctttgaagccgggatggggctgttttgagtgaatttgttctctcttttcagatgcctacgcgagaggatctggggcttccacttcgaatgcatgtacgctgtcagccatcagtacaataatgatttccctcacagctaggtccagtttatgacaaaagttatctgaaggacttgctgtttataatataagcaacatttagctagttgttttgaagacacccagtactaagtaatattgttgttcaagtacatcttattactggaataaaaatgttttttgcttctttaggaatggcattatacagtacttcctcaaagcaaatctagctttgtctgaagtttctttggaaactctgcaatgcactgaagacatctgtaatatgatgttaccaaagcagtttacatatgtccttatatgcatattttttattatatatttagtgttttatagaattttttaaagttaacatataatgtagatattaattttttcctcggctgtaaaatgctatgggcaacacaatcatgcaattataatttgaaaatatttcctttaaagacagagtttgaaactcatcttggtaaataaattgcaaattactcgtacagttttacaaggatctcatggcagaacagcggaagacttggtccgtaactcaaggctgttgtatgcaaactactcttctagtggttaatgcacttgacatgtacagtatgtttcccatgccgttgtgattttgacatgtacagtatgttttcatgccgttgtgaattttgttgttcaacccaacttgagatggtttcaggaatggctgcaatctcaaaagctcaatgtactgcccaagaggcaccttgtgcaatattcccatccctgaatttagcattgtacaggaagattttcttttcactcaactgagttagcattgtctttgtggtagcattatcttagacattaaatttgaagtaacatatatcctgtagtaacatagacccaaagttactatagtcaaccaagtctttcaaaggataaaagatcattttattatctttaactgtatctattttgaatgtaaatttaaaaaaagtaattctctgtcaatggattcgtaatttctttacaaaatttcttatatataatatgtgtatctctgtaataatagagcccttcttttgaatcaaaattacatatggactttggaagattgctcctatttcaacaaatagttgctgcaagaatttttaatatgactctataaaagctctttagtacaattgtatggtttcttgatgattctgttttgcaataggtagcctagttgctttatatgctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaagatacttgtctttcgggagcatttttcctgcctgcctgtcagggaatttgttagcttacctttgtgctagttataatttgggatcatagagggactcaaaagtctctacccaaatctagatgacccagagcttttcctttggaattgacaaccctgaagcaccatttcaaatcctctttggaagtagagagggtcctaatccacaagtaaatgtcctgaagatgagacttgaatattttctcttgattagctaagtcttttgtatatttactgtaagtatatctgttgtttccctcaccccccattgctaaaagggtaagttctaagcttgagcatttaaggctcttttttttttgagacggagtctcactcttgtcacccaggctggagtgcaatgttgcgatctcggctcactgcaacctccgcctcccaggttcaagcaattctcctgcctcagcctcccgaggcgcccaccactacaccggactaatttttggatttttagtagagacgagatttcaccatgttagtcaggctggtctcaaacacctgacctcaggtgatctgcccgcctcggcctcccacagtgctgggattacaggcttgagccaccgcacccggcccttaaggccctttttaatccaaaacgatttaactgtgtatccagccacagtaagccctccctgacccctgaacactgcttgcttttggtctcacctctgtgcctttggtcttatggctgccccttcctgaaatgccttctccacccttctctcccattcagatccctgctgtcctagggtagctccagccccagtttgtctgcaaagacttcccatgcttcagtcctttatgacattctcgcttggaagtagttgcatcccctatcaatgctgctcatttagtaattaatcagatactacttttggaaatctcttgtactgttatcttgcattttaatttaactcctgtattgttacttactttttcttgtatgtatggcttgtcttcccaactagattgtaagctccttgagggcagggactttggtcttatcttccatgtactctccatagtgcctagcacagtgccttgcaataaatactcactgattaattgaatgaaggggtctttgaagtagcattttgcatcagttgcctgcctgtgtgccacagcaaaccaaccagggaagactgtgtcattactttcgttatgtgctgaaaagcgttaaaaggcctggcttctaactttgtacctggaagaagtctttgaccaattggcttcatcatcgggtaaatgaggtcctggattagttgagtctaactgaattgaagatgttttagaaagtgccccatgagcacctccacccaaacttgtctcatttgttggctttcatggttgcctcaggtagggtccactggctgtaagcaaagaaacgaccctgggtaacttgagcaaacaaaaagtaaggaattagaatgacacaggttacatcatatgagccaaggaaacactgaaggaccaactcttgaggagaataagaaccaggccactctgtgggtccagacaatgggaactttggaaagtctttttggggtgctattgtggggatgaatcagctttgtttccaattttgacgccattatgctcaatattcagattcctgggaaagtgatcagttccatttgagttccacagccagagtaccttgtactcacaggggagggatagttaaaggaaaactaagatgctgttttccaaaggtaagagaagaaatgctgggttggtataagtaacagattttctaggcttagccagccaaggggactttcttaggcccttagcccaagtaatacactcgagtggaatgactatattgctgcttgagatttttttctgaaggaggaccactaggaaaatttgctttgcttgtttaacctttcaaagtgcttactcttgccctcctttttgtgtgtgtagtccacttgtgatttaactgtatgaaaggaaattctattgtgccagatatttggattctctcagtgtacctactttctatggagcccacacatgctacatacaaagcagcacctttccatgggcacagaagacatggatgataagcttcatttctcaggtaagctctgaattcttccagcctgtgaggtagaaggtgcatagactttgatattaagaaagaatgattgtgttattcccaccatcaaaattgtggttgtttatatccaggaggcaatgttaaatcctgattaacctttacccagtctcttccaccaccttgcctcactacaaatatgcgcaaagaatgttgagttataaaaagtatacaaatagcacataattagcaacaaaaatgtcatgcagtttttaatctaatgtaatcaaccaacaggtgatttttgttcactacattggattatcgatgctactgttctcctccgttaacacttataatcaagaagtgactgttattttcctgttgttacaatttacaaaatgttctggctaaaaacgttatgtggccaaccatagtgctttgaaaggcaagcctttaaaatcaaggacttatattcaatctgtggacataccccagatttttccattacaaaatgccagacactgaggccttacaaaggcagcctaatacaaagactaaggacgtggatcctggagtttgactgcctggggtgcattgtaatgattggctacttattagggaggataaagtttgtaaagctctccaaacagtgatgattttaccgtctgttattgttctttttctccagggactttactagacccacagatgtaggatgtggatgcttcttatcaccaaaatgagtggaactcagctgacacatccattatcaccttttatttaaacatgatcacttcttaatataaattttaatgttcgataattttaatcatacaatcaactaattcaaacttaggcagtagggttcccattcagatgccaggttttgcacaaagcctccctcagcttccccatctgaaattgaccttgcatttctctgacctccaggggatggggtctgtacccactcatgtcagtcatcccttcgtaccttatatttaaatcatttttgttggtgtcttccgccttatagtagacacacggcacctcagcgttggcatctgggtgtggttcctcattgtgctcccaggcacaaggcctgtgtcacctccatctcagacctagagggaggagaatatctggccccgtttcctgtgatttcctcaggccccctgccagagtgtgattagtaaatgcaagtcaggctgcccattctgcaaagaggccccgtttccccttgtgctaaatgggccatgcggattaaatgttccagctctgcaactcacctgcaaactacaatactcaacagagatcacagtttaaacaaaattggcctctatcctttatcacaagcagttatgggccatggtagattagcagagctctagtgatatagatcacatagagagaaagctttttttaaaaaaggtcaaccatatgatcgatctgaaagtctggaaattggaaggctgagctacttaaatatagatgcaattacatgtgatatccccattctctgtaaactgggtttttgccacatatccttattgttaggaataacacgaactataccaggaaatatatatgtcctaggactttaacaaatagtaatatctttaatttgtttttctagttttcaaagtgcttttcacactaataaggggaggacataggtttttattccttttttatttatgaaatggaagcaaagaggttatataagaagcccaaagtaacatagacaattagaaagtcagggctgggcatggtggctcacacctgtaatcccagcactttgggagactgaggtggggggatcacaaggtcaagagttcgagaccagcctggccaacatggtgaaaccccattcctactaaaaatacaaaaattagctgggcatggtggcacgtgcttgtagtcccagttacccaggaggctgaggcaggaggattgcttgaacctgggaggcagaggttgtagtgagctgagattgccctactgcactctagcctgggcaagagagtgagactctgtctcaaacaaaagaaaaaaaaaaaaagaaggactagaatttagaacatagactcattagtgcatttcatacacctagaaataagtacttagagaaaggacaggatggagtaaggaactagactctgaagttcaactagagaacattctaggacaagtaggtaggccagaggaaatggtgaggtagaagggtgagatgtctgaggttcagatgctggaggtggagaagttctgagtgccggccaggcccagggcacagccatctggaggaatgggataggataggtgcctggagagggttttagttattcagcaagggactactggcagccctctctgtaccaggcactattctgggcatagaagaatgatgtggcattcagatgtgtgtgaggaagccaaggcaccagtaacagtattttgtcacaatacagagaaatgcaatgataataataatagtaaacagtgattatgcttataatatgtgccagactcagtgcaaatcaacctaccgatttagttaccatttattattcctattttatacacagaggattgaggttgacaggttcacatttgtccctgatcacacagttgatcagagagaccaggaattgaaatgctggtggcttgggtttagggccctactccaaaacattagatgtctctatctgtaaatagatgatacataaacaataaggtaggtagatagataaatagacagatagatacggttcccatatagcaacaagaaggaaaggcagtcatgagcttcagtctgctctaaagtggctcagcttctctgcttctctttccttgactgcaaatgttgttttttgcgtgttcgttgtccttgacttcaggtgtcttagagctgtttctttaaactccggctacccttcaagatcaggattacccaataaaataggagaggagctattaaacttagatttcagataaaaaaaaaattatgcttccttagtataagtatgccccatgtgatatttatttgaaattcaactttaactgagcctcttatttttatttgctaaatctggcaacctgacaccaggaggtcttcattactctcattgaagtaattaatttgtaattcaaaatttcagggtcttgcgaatgtgttgtcagatctctgaaggtcaatggctctgagggcgagacatgaagtttgctgttttgagttctgtttcgtttgctgaactctccttcccacttttccttggatggtgtgaggatgggatgtgtgtgtgtccagagagacagggctggtgggtgaagttcctcttagagctggcagaaaagaggttttgttttttttttgtttgttttttgagacggaattttgctcttgttgcccaggatagagtgcaatggcgcaatctcggctcactgcaacctccgcctcccgggttcaagtgattctcctgcctcagcgtcctgagtagctgggattacaagcatgcgccgccacgcctggctaattttgtatttttagtagagacgggtttctccatgttggtcaggctggtctcgaacccctgatctcaggtgatccacccaccttggcttctcaaagtgctgagatgacaggcgtgaggcaccgcacccagcccagaaaagagttttaagacaagggaatctttccccagcaaaggcccacattatgtggcaagaaggtgttaaagcaggtggaagggattccagaaatattctgaaagcttaaaaaaatgggtttgttgccaggaacataggccacagcacagctcgttggaaaactatgtagtggacgcatcgtttatcaactgcagtgttgggaccaaatatccgagaccaaataactggcagttagaattggcccagttgttcctcttgaatttagtggttaacaaataagatattgagtgcatactatgtgtcaagcacttgctgggcactggagaaactgagataaatagggttaaggcttccctcatggttcactgaaggagacagaaatacacttattgaaggatggtgtgaatagtgtgacagataaaggtatgaacacaatgctggacctgtgtttcttgcaaaacctacttataatgaggttaagttcagtcaaacacaattttttttaccattgatcccccaggatagaatattttcatttgattaaacatgattattttcccaaattggttgcttttcttaaaaaaaagaaaaacacattcataaatattttgaatccattaagccatgtgtcaatattggccctctgggaaaatctagctcattgcccgctttttttgtaaatcaagatttattgcaacatagccatgctgatttatagattgcctacggccactctgtgctatcacggaagaactgagtggctgccacaaagaccatatggtcctcaaagctgaaaatatttactatctagccctttaagaagagtttgctggctcgtgcctgtaattccaacactttgggaggccaagggctggatgatcacttgagcccagtagttcaagaccagcctgggcaacatgggagaccctgtgtctacaaaaaaattttataaattagctgggcatggtggcacacccatgtggtcccagctacgcgagaggctgaggtgggaggatcatttgagcccgggaggtcgaggctggagtgaacggtgatcacagcactgcactccagcctttccagcctgggtgagacaggagaccctgtcttaaaaaaaaaaaaaaaaaggcagcagcagcttgccgacctttaaactacgacaccagtactttattgctgatttcgttcttgcaattttcccctcaggtttctgtgttcttccagtttattacttggcagggacaaatctttgcttttaattttaataaatgaaacaaacctaataaaacaccttcaagttgaaaagagtccgctagaactttaaaatcatgcacatgggccatatgggcggctttgtgttgctcctgacaaccaacaacgcagatgtctactgagagccaaatggtgggtgatgccggccgcggaggtggagggcagcgtttctgagaccagcatcacacccactgtgagtttttactacttcattaatttaagctccagtgacgatttaacttctgctataaccacacagctttaataaatgaacctaccattagaacatagttctttagaatctatattgttttccgttcttttaaatgtttaataagctcacttccttttccttcgtctggttactcaaccagcagtcagttcctccttggggcttatggacacaaagataagtcagacactgctcttggcctcagagtgtttgcactggaaacgagacagagcattggtgaggagtccaggccaggtgcggtggctcacgcctgtcatcccagcactttgggaggccgaggcgggtggatcacgaggtcaggagatcgagaccatcctggccaacatggtgaaaacccgtctctgctaaaaatataaaaattagctggctgtggtggcacgtgcctgtaggcccagctactggggaggctgaggcaggagaatggcttgagacccggaggcggcgattgcagtgaaccgagatctcgccaccgcactccagcctgggcgacagagtcagactctgtctcaaaataaataaataaatgaaagtccaatcactgatagaattaaacaaaaggaacatagagggacacttaattcaaactggaagttgagcaaagattttcaggtggcaaagagccgagacttagaagataaatcaaaatgtcaacaaaatgaaaagaggttgaaaaggctttttccaccagagaaagtttcggcagaggcatggagtgatgcagtagcatggagctacagggaaatcatcagcacattggtgagaatggaggtaggagtatttgggtatgtgcctggagagctagtaaggagctgagtcatagtggactttgccttaaaaggagctttaacttgaaggtgatggggagttatataggcagatgtgccttttacattgatccttcaaagggaggaaatactggaggccatgagttcagttcagaggctactgtaatagtcctagctgagagatggaggaagacaatggtggggacagagaaggggaatatttaggggaaaaatgagaaaggtacccacccctctttaattgcagacttagacaattcactgtcatttatgtttaatatttctcattctgaaacatatttatattcacatctattacctacaaaacaggagataagcatgattgtcttatagtacaatacaaaattccaaaggaaggaatggttttgaaaaaatttgcaccctggtactcaatttgaaggatgtagaagcaggaatagctacagtccttaggctagcaccaagtcctattctaattaggtttttcacctttacttgtgccatcagagattgttttcagttctctgttctcacttccagatatctactttttctttaacaaattagcacctcaggcttcttaattccaccagcagatggtcctgacacatagaagtctcaccatgaaaacgtttggatttttaatcaggatgttctttgcccacgtggattcttccccagcctgcatgaatagcttgaggtctgaggcatttcaatgaggctcaggtggtcgggctgttggcaaatgtgaccttcaccctccagtctccccagcactcccccatgctgcacgcagtgaattccaaatgccaaggaaagaaattgggctaaaaatccctattggaacggatatcttggaaaagcatgtttgttctgatcccgtggctgtggaggctctaggagaaaagtgactctctacactcgtcctagtgagagatggcaagagatgggagccaatatcatgactttaccttacatcaacctgctgctgatggtgtttactgttaagtgaatttcaaactctttgacttgctatgacaaggctggtgagaacagtatagaccactcacagtgagccacttctgaaatgcctcttacacagcaatttatacataaccatttagacactttggcagcaaaaacatccaggttgcagtagcccagttgttaggcacatgtgtctcctggttgcttctaactaaccgcattctcattagatacccagcttcctccccctgtcattattgtaggccttgaggatctctgccaaatactgttcagtctaacctatatacaaggtgccgtatcagggctgacagagggtttaagaaacatttatattttcttaagtcagatactgtcctagacactgcagataaaaagacgtatttcacacaagctccatcctcctggaagccgcagtctagaggggaggcctcccagctgttaatggtatattctacaatgcagtagctctaacacgggtatgaggcccagaatgagaatccagaggcgggatcaaccaactctgcttttgaaggcttcatggaggaagtgatgatggttacgggttcccaaagaatgactatgagttgcacagggcaagaagggaggaaggagttcccaatccaccaaggaggccaatgggctactttgtgttgctcctgaaacacatataccaagggccagataacggtaccagctcagggaagtgtggcaaggagctccacagagcccaggtgatctatggctgctgagtggagggaggagtctgaagtgggcaccacaccaagcactgaagagctggccacatttgtggagggggagctccctgcttctgttcctgcctcctaagcagaggcagtttccacaatgccaactgtctgggttgtggt
